United States Patent
Chen et al.

(10) Patent No.: US 12,442,025 B2
(45) Date of Patent: Oct. 14, 2025

(54) ENGINEERED POLYPEPTIDES AND ITS APPLICATION IN THE SYNTHESIS OF TYROSINE OR TYROSINE DERIVATIVES

(71) Applicant: Enzymaster (Ningbo) Bio-Engineering Co., Ltd, Ningbo (CN)

(72) Inventors: Haibin Chen, Ningbo (CN); Chengxiao Zhang, Ningbo (CN); Shumin Shi, Ningbo (CN); Baoqin Cai, Ningbo (CN); Lei Sun, Ningbo (CN); Qinli Peng, Ningbo (CN); Zikun Wang, Ningbo (CN); Yong Koy Bong, Ningbo (CN)

(73) Assignee: Enzymaster (NINGBO) Bio-Engineering Co., Ltd., Zhejiang (CN)

( * ) Notice: Subject to any disclaimer, the term of this patent is extended or adjusted under 35 U.S.C. 154(b) by 957 days.

(21) Appl. No.: 17/440,954

(22) PCT Filed: Mar. 30, 2020

(86) PCT No.: PCT/CN2020/082139
§ 371 (c)(1),
(2) Date: Sep. 20, 2021

(87) PCT Pub. No.: WO2020/207282
PCT Pub. Date: Oct. 15, 2020

(65) Prior Publication Data
US 2023/0010880 A1   Jan. 12, 2023

(30) Foreign Application Priority Data
Apr. 7, 2019 (CN) .......................... 201910274690.2

(51) Int. Cl.
*C12N 9/88* (2006.01)
*C12N 15/70* (2006.01)
*C12P 13/04* (2006.01)
*C12P 13/22* (2006.01)
*C12N 15/10* (2006.01)
*C40B 40/08* (2006.01)

(52) U.S. Cl.
CPC ................ *C12P 13/04* (2013.01); *C12N 9/88* (2013.01); *C12N 15/70* (2013.01); *C12P 13/225* (2013.01); *C12N 15/1034* (2013.01); *C12Y 401/99002* (2013.01); *C40B 40/08* (2013.01)

(58) Field of Classification Search
CPC .. C12N 9/88; C12N 15/70; C12N 5/10; C12P 17/10; C12P 5/005; C12P 13/04; C12P 13/225; C12P 13/22; C12Y 401/99002
See application file for complete search history.

(56) References Cited

FOREIGN PATENT DOCUMENTS

| | | |
|---|---|---|
| CN | 103820410 A | 5/2014 |
| CN | 104059891 A | 9/2014 |
| CN | 106497990 A | 3/2017 |
| CN | 106591383 A | 4/2017 |
| CN | 106701843 A | 5/2017 |
| JP | 2006-320238 A | 11/2006 |

OTHER PUBLICATIONS

Kisselev L., (Structure, 2002, vol. 10: 8-9.*
Kwiatkowski et al., (Biochemistry 38:11643-11650, 1999.*
Wristlock et al., (Quarterly Reviews of Biophysics 2003, vol. 36 (3): 307-340.*
Davos et al., (Proteins: Structure, Function and Genetics, 2000, vol. 41: 98-107.*
A.A. Antson et al., "Three-Dimensional Structure of Tyrosing-Phenol-Lyase", Biochemistry, vol. 32, No. 16, pp. 4195-4206 (Dec. 31, 1993).

* cited by examiner

*Primary Examiner* — Tekchand Saidha
*Assistant Examiner* — Mohammad Y Meah
(74) *Attorney, Agent, or Firm* — Smith Patent, LLC; Chalin A. Smith

(57) ABSTRACT

Provided are efficient catalyst of engineered enzymes and an economical enzymatic reaction solution to solve the problems in the current production process of L-tyrosine and its derivatives. The method of the invention has the advantages of high product concentration, mild reaction conditions, simple purification process, simple operation, environmental friendliness, and easy industrial scale-up. Thus, it has good industrial application prospects.

22 Claims, 1 Drawing Sheet
Specification includes a Sequence Listing.

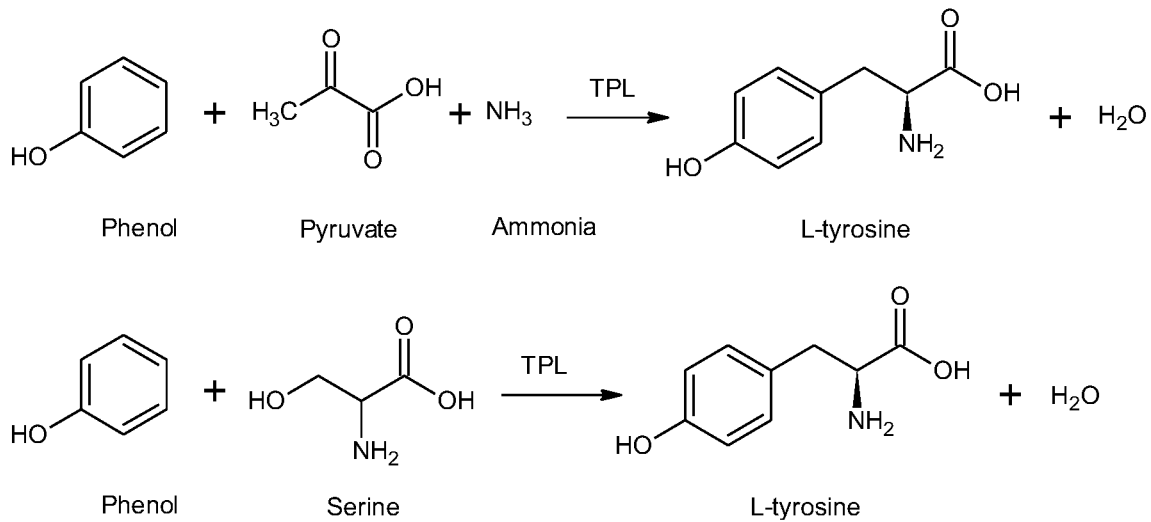

ENGINEERED POLYPEPTIDES AND ITS APPLICATION IN THE SYNTHESIS OF TYROSINE OR TYROSINE DERIVATIVES

PRIORITY

This application corresponds to the U.S. National phase of International Application No. PCT/CN2020/082139, filed Mar. 30, 2020, which, in turn, claims priority to Chinese Patent Application No. 2019-10274690.2 filed Apr. 7, 2019, the contents of which are incorporated by reference herein in their entirety.

SEQUENCE LISTING

The instant application contains a Sequence Listing that has been submitted in ASCII format via EFS-Web and is hereby incorporated by reference in its entirety. Said ASCII copy, created on Sep. 17, 2021, is named LNK_232US_SEQ_LIST_TXT.txt and is 910,008 bytes in size.

TECHNICAL FIELD OF THE PRESENT INVENTION

The invention relates to the field of bioengineering technology, in particular to engineered polypeptides and application thereof.

BACKGROUND OF THE PRESENT INVENTION

L-Tyrosine is an important nutritional amino acid in animals. It can be used as nutritional supplement and raw material for the preparation of peptide hormones, antibiotics and other pharmaceutical and chemical products. It is widely used in food, feed, pharmaceutical and chemical industries. L-tyrosine derivatives also have important industrial applications, such as L-DOPA (L-3-hydroxytyrosine), which is an important biologically active substance that can be converted into dopamine to treat Parkinson syndrome; 3-fluoro-L-tyrosine is widely used in biochemical research, can be used to prepare modified proteins, study substrate specificity of enzymes, and synthesize fluorine-containing markers to simulate metabolic processes; 3-methoxy-L-tyrosine can be used in the synthesis of ferulic acid and other substances, and it is an important pharmaceutical intermediate; azatyrosine has potential medicinal value.

At present, there are three main methods for preparing L-tyrosine or L-DOPA: (1) Extraction method: natural protein resources such as casein, pig blood, etc. can be used as raw materials to prepare L-tyrosine. After hydrolysis of raw materials crude L-tyrosine is extracted and concentrated, followed by crystallization and decolorization to obtain the final product. The disadvantage of this method is that it is difficult to isolate high-purity L-tyrosine, and the content of L-tyrosine in natural protein resources is low, so the yield is low and not suitable for large-scale production. The method of extracting L-DOPA from plants such as quinoa beans and cat beans is limited by the availability of the raw materials, and the steps are complicated and the yield is low, so this method cannot meet the market demand. (2) Chemical synthesis method: L-Tyrosine can be obtained through L-phenylalanine hydroxylation. L-Tyrosine can also be obtained through condensation of para-hydroxybenzaldehyde and hydantoin, followed by alkali hydrolysis, transamination steps. The disadvantage of such chemical method is that the process is complicated and there are many reaction steps, and the produced racemic tyrosine requires resolution to obtain physiologically active L-tyrosine. For asymmetric synthesis of L-DOPA, the process requires 8 steps; due to the harsh reaction conditions, high cost, low conversion rate and low stereoselectivity, it has suffered from industrial production restrictions, and does not meet the requirements for the use as pharmaceuticals; (3) Enzymatic method: It mainly uses tyrosine phenol-lyase (TPL, Enzyme Commission classification number EC 4.1.99.2) to catalyze the conversion of pyruvate, ammonia and phenol or catechol to L-Tyrosine or L-DOPA. This reaction is reversible and requires pyridoxal phosphate (PLP) as a coenzyme.

In addition, if phenol is replaced by o-fluorophenol, guaiacol or hydroxypyridine, TPL can also catalyze the formation of 3-fluoro-L-tyrosine, 3-methoxy-L-tyrosine and azatyrosine. Enzymatic conversion has the advantages of high specificity, mild reaction conditions, high selectivity, and environmental friendliness. It has important development prospects in industrial production of L-tyrosine and its derivatives. However, wild-type TPL has problems such as insufficient stability, especially the high substrate concentration tends to inactivate wild-type TPL, so in practical applications, only low substrate concentration can be maintained. It is also necessary to load TPL in the reaction in the form of whole cell of a TPL-expressing microorganism, so that the TPL inside the cell is isolated from the substrate outside the cell in order to avoid rapid inactivation by substrate. This reaction process has a few disadvantages (Appl Microbiol Biotechnol (2007) 77: 751-762), the first is that the space-time yield is not high (that is, the accumulated product concentration per unit time is low, resulting in low production efficiency and high production costs); the whole cell will also metabolize alanine, one of the reaction raw materials, into other by-products, resulting in waste of raw materials. At the same time, the separation of the product (the form of the product is solid) from the whole cell after the reaction also adds additional costs. Therefore, it is important to develop engineered TPL polypeptides with better stability and/or high activity to realize a simple and convenient reaction process without using whole cells, with high space-time yield, and to achieve the industrial production of L-tyrosine and its derivatives.

Summary of the Present Invention: The invention provides engineered polypeptides with good stability to phenolic substrates and high catalytic efficiency, which can be used for producing L-tyrosine and its derivatives, including levodopa. The invention also provides gene sequences of engineered polypeptides, recombinant expression vectors containing the genes, engineered strains and efficient methods for the production thereof, as well as reaction processes for preparing L-tyrosine and its derivatives using the engineered polypeptides. Using the engineered polypeptides and related reaction process provided by the present invention, the final concentration of L-tyrosine that can be produced within 24 hours is as high as 200 g/L, which greatly improves the space-time yield. The engineered polypeptide provided by the present invention participates in the reaction in the form of a clarified enzyme solution, and the product can be easily isolated in a solid format, which simplifies the purification process and reduces the manufacturing cost.

In the first aspect, the present invention provides novel engineered polypeptides. These engineered peptides were derived from a wild-type tyrosine phenol lyase (TPL, Enzyme Commission number: EC 4.1.99.2) through substitutions, insertions, or deletions of a number of amino acid residues through a creative directed evolution process. For an introduction to directed evolution techniques, see "Directed Evolution: Bringing New Chemistry to Life" Frances H. Arnold, Angewandte Chemie, Nov. 28, 2017. Frances H. Arnold received 2018 Nobel Prize in Chemistry due to her pioneering contribution to enzyme directed evolution technology. The wild-type TPL is derived from *Citrobacter freundii*, and its amino acid sequence is shown in SEQ ID No 2. As tested by the inventors, the wild-type TPL corresponding to SEQ ID No 2 has the activity of synthesizing L-tyrosine. It is able to catalyze the synthesis of L-tyrosine from phenol, pyruvate, and ammonia, and it can also convert phenol and serine (D-serine Or L-serine) to L-tyrosine (FIG. 1). However, the stability of this wild-type TPL corresponding to SEQ ID No 2 is very low, and it is easily denatured and inactivated in a solution environment where phenolic substrates such as phenol and catechol are present. It is well known in the field of molecular biology that phenol is a strong protein denaturant. In the process of nucleic acid extraction, phenol is often used to denature proteins to achieve separation of proteins from nucleic acids.

As tested by the inventors, in the reaction system shown in FIG. 1, when the concentration of phenol is ≥20 g/L, the wild-type TPL corresponding to SEQ ID No: 2 is quickly and completely denatured and loses activity, and almost no L-tyrosine is formed. When the phenol concentration is reduced to about 3 g/L, although the enzyme corresponding to SEQ ID No: 2 is not immediately inactivated and can catalyze the reaction shown in FIG. 1, it is still completely denatured and inactivated in ≤20 h reaction in solution containing 3 g/L phenol. Even if an optimized reaction process of dosing phenol is used (as shown in Example 8 or Example 9), the enzyme corresponding to SEQ ID No: 2 can only convert a small part of the substrate, resulting in a low concentration and no prospect for industrial production. In order to improve the stability of this enzyme against phenolic substrates such as phenol, the inventors have developed a series of engineered TPL polypeptides. These engineered peptides have shown better stability and/or activity than SEQ ID No: 2 in the enzymatic synthesis of L-tyrosine and its derivatives, and the engineered peptides can catalyze the synthesis of L-tyrosine using phenol as well as the synthesis of L-DOPA using catechol more efficiently. In some embodiments, the engineered polypeptides in the present disclosure are capable of catalyzing the synthesis of L-tyrosine and derivatives thereof with a stability and/or activity at least equal to or greater than SEQ ID No: 2.

Compared with the wild-type TPL corresponding to SEQ ID No: 2, the engineered polypeptides provided by the present invention have better stability and/or activity and can asymmetrically synthesize L-tyrosine and derivatives thereof with a very low-cost and extremely simple process. These engineered polypeptides may comprise an amino acid sequence that differs from the sequence of SEQ ID NO: 2 in one or more residue positions selected from: X3, X10, X17, X27, X29, X33, X39, X41, X43, X59, X66, X72, X75, X78, X118, X128, X132, X136, X137, X140, X146, X174, X179, X186, X206, X212, X233, X253, X255, X276, X280, X284, X288, X327, X343, X354, X379, X384, X390, X391, X396, X414, X418, X429, X445, X446, X448, X449, X454. In some embodiments, the engineered polypeptides comprise an amino acid sequence comprising at least one of the following features (these features are substitutions of amino acid residues to the reference sequence of SEQ ID NO: 2):Y3C, Y3F, I10T, S17R, S17K, K27A, K27E, K27R, K27N, K27T, K27Q, K27H, K27S, Q29K, Y33W, N39K, N39Y, N39R, N39H, K41R, K41S, K41T, K41Q, K41N, K41A, K41H, K41D, K41E, I43T, I43C, K59H, M66L, A72C, E75Q, E75R, E75K, Y78T, A118L, Y128L, Y128I, Y128V, Y128W, Y128H, Y128R, K132R, K132L, K132N, V136T, V136I, V136M, F137A, I140V, I140L, H146L, H146E, N174K, C179S, L186N, L186I, A206K, F212Y, E233K, E233H, E233Q, M253H, G255P, S276E, E280N, V284A, M288G, M288L, M288A, M288F, M288H, M288S, D327A, D327E, H343A, H343R, E354P, M379G, I384V, N390K, V391K, H396P, Y414R, D418N, Q429D, Q445G, Q445T, Q445Y, L446N, F448H, F448K, F448M, F449M, F449V, F449Y, D454E; Or, in addition to the abovementioned differences, engineered polypeptides comprise insertions or deletions of 1, 2, 3, 4, 5, 6, 7, 8, 9, 10, 11, 12, 13, 14, 15, 16, 18, 20, 21, 22, 23, 24, 25 or more amino acid residues.

More specifically, in some embodiments, the engineered polypeptides developed on the basis of SEQ ID No: 2 comprise a sequence corresponding to SEQ ID No: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308.

In some embodiments, the engineered polypeptides comprise an amino acid sequence that is at least 80%, 81%, 82%, 83%, 84%, 85%, 86%, 87%, 88%, 89%, 90%, 91%, 92%, 93%, 94%, 95%, 96%, 97%, 98%, 99% or more identical to the reference sequences of SEQ ID No: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308.

The identity between two amino acid sequences or two nucleotide sequences can be obtained by commonly used algorithms in the art and can be calculated according to default parameters by using NCBI Blastp and Blastn software, or by using the Clustal W algorithm (Nucleic Acid Research 22 (22): 4673-4680, 1994). For example, using the Clustal W algorithm, the amino acid sequence identity of SEQ ID No: 2 and SEQ ID No: 286 is 96.9%.

In another aspect, this invention provides polynucleotide sequences encoding engineered polypeptides. In some embodiments, a polynucleotide can be part of an expression vector having one or more control sequences for the expression of an engineered polypeptide. In some embodiments, polynucleotides can comprise sequences corresponding to SEQ ID No: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307.

As known to people skilled in the art, due to the degeneracy of the nucleotide codons, the polynucleotide sequences encoding amino acid sequences SEQ ID No: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308 are not limited to SEQ ID No: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307. The polynucleotide sequences of the engineered polypeptides of the present invention may also be any other polynucleotide sequences encoding amino acid sequences SEQ ID No: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308.

In another aspect, this disclosure provides polynucleotides comprising sequences encoding engineered polypeptides, expression vectors and host cells capable of expressing engineered polypeptides. In some embodiments, the host cell can be bacterial host cell, such as *E. coli*. The host cell can be used to express and isolate the engineered polypeptides described herein, or alternatively be directly used in the reaction for conversion of substrates to products.

In some embodiments, the engineered polypeptides in the form of whole cell, crude extract, isolated polypeptide, or purified polypeptide can be used alone or in an immobilized form, such as immobilized on a resin.

The present disclosure also provides the process for catalyzing the synthesis of a chiral amino acid compound represented by structural formula (I) using the engineered polypeptides disclosed herein:

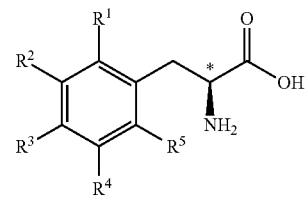

where the amino acid products of formula (I) have the indicated stereochemical configuration shown at the chiral center marked with *; the amino acid products of formula (I) are in enantiomeric excess over the other isomer, where $R^1$, $R^2$, $R^3$, $R^4$ or $R^5$ are optionally substituted or unsubstituted $C_1$-$C_6$ hydrocarbyl, —H, halogen (such as —F, —Cl, —Br and —I), —OH, alkenyl, alkynyl, aryl, heteroaryl, —$NO_2$, —NO, —$SO_2R'$ or —SOR', —SR', —NR'R', —OR', —$CO_2R'$ or —COR', —C(O)NR', —$SO_2NH_2$ or —$SONH_2$, —CN, $CF_3$; wherein each R' is independently selected from —H, ($C_1$-$C_4$) hydrocarbyl, halogen, $C_1$-$C_8$ hydrocarbyl, $C_2$-$C_{12}$ alkenyl, $C_2$-$C_{12}$ alkynyl, cycloalkyl, aryl or heterocyclic. The process comprises that, under suitable reaction conditions, in the presence of pyruvate and ammonia or in the presence of serine (as shown in the following reaction formula 1 or 2), the substrate of the formula (II)

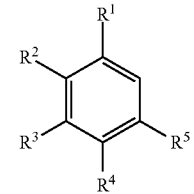

is contacted with an engineered polypeptide as described herein.

Reaction formula 1

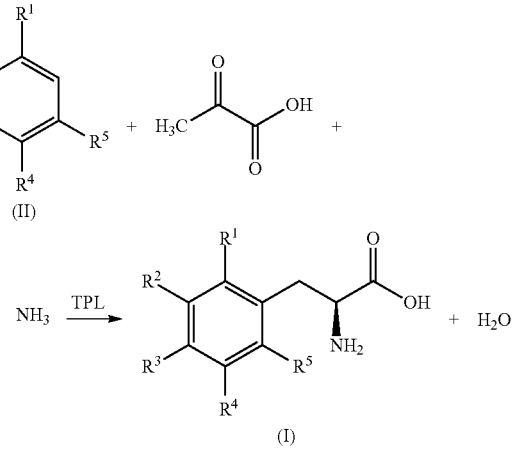

-continued
Reaction formula 2

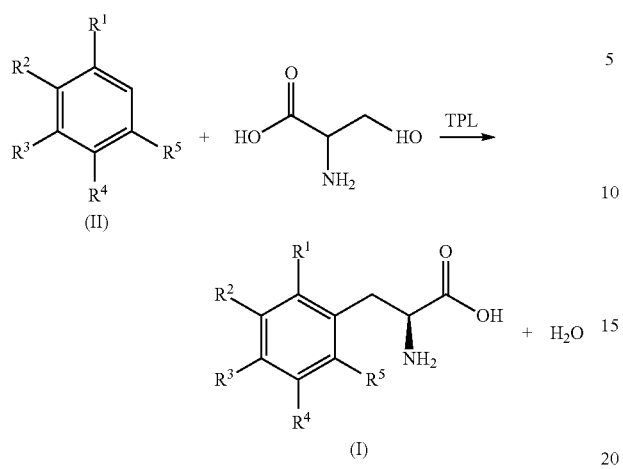

In some embodiments, the engineered polypeptides have at least 80%, 81%, 82%, 83%, 84%, 85%, 86%, 87%, 88%, 89%, 90%, 91%, 92%, 93%, 94%, 95%, 96%, 97%, 98%, 99% or more of sequence identity to a reference sequence that is an even sequence identifier of SEQ ID No: 2-308, and are capable of catalyzing the synthesis of the product of formula (I) with better performance (including better stability, higher activity, or tolerance to higher substrate concentration) compared to SEQ ID No: 2.

In some embodiments, the product of formula (I) is produced in an enantiomer excess of at least 90%, 91%, 92%, 93%, 94%, 95%, 96%, 97%, 98%, or 99% or more.

In some embodiments of the process, the product of formula (I) is:

wherein $R^1$ is as defined above, and the substrate of formula (II) is:

In some embodiments, $R^1$ is in the para position of the phenyl ring. In some embodiments, $R^1$ is in the meta position of the phenyl ring. In some embodiments, $R^1$ is in the ortho position of the phenyl ring. In some embodiments, $R^1$ is in both the para and meta positions of the phenyl ring. In some embodiments, $R^1$ is both para and ortho to the phenyl ring. In some embodiments, $R^1$ is both meta and ortho to the phenyl ring.

In some embodiments, the engineered polypeptides disclosed herein can be used in a process of preparing L-tyrosine:

L-tyrosine

In these embodiments, the process comprises that, under suitable reaction conditions, in the presence of pyruvate and ammonia, or in the presence of serine, the compound of formula A1, phenol

A1 was contacted with the engineered polypeptides disclosed herein.

In some embodiments, the engineered polypeptides disclosed herein can be used in a process of preparing L-DOPA:

L-DOPA

In these embodiments, the process comprises that, under suitable reaction conditions, in the presence of pyruvate and ammonia, or in the presence of serine, the compound of formula A2, catechol

A2 was contacted with the engineered polypeptides disclosed herein.

In some embodiments of the above process, the compound of formula (I), L-tyrosine or L-DOPA is produced in an enantiomeric excess of at least 90%, 91%, 92%, 93%, 94%, 95%, 96%, 97%, 98% or 99% or more.

Specific embodiments of the engineered polypeptides for use in this process are further provided in the detailed description or examples. An engineered polypeptide that can be used in the above process can comprise one or more sequences selected from the amino acid sequences corresponding to SEQ ID No: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308.

Any of the processes for the preparation of a compound of formula (I), L-tyrosine or L-DOPA using an engineered polypeptide as disclosed herein can be performed under a range of suitable reaction conditions, which include, but not limited to, pH, temperature, buffer, solvent system, substrate loading, polypeptide loading, cofactor loading, pressure, and reaction time range. For example, in some embodiments, preparing a compound of formula (I), L-tyrosine, or L-DOPA, can be performed, wherein suitable reaction conditions include: (a) about 1 g/L to about 500 g/L of compound (II), phenol, or catechol; (b) about 0.1 g/L to about 50 g/L of engineered polypeptide; (c) about 0.01 g/L to about 1.0 g/L of cofactor; (d) 0% (v/v) to about 99% (v/v) of organic solvents, the organic solvents described herein, include but are not limited to, 4-hydroxy-2-butanone, isopropanol, dimethyl sulfoxide (DMSO), dimethylformamide (DMF), methyl tert-butyl ether (MTBE), isopropyl acetate, methanol, ethanol, or propanol; (e) a pH of about 4.0 to about 11.0; and (f) a temperature of about 10° C. to about 60° C.

BRIEF DESCRIPTION OF THE FIGURE(S)

FIG. 1 depicts the synthesis of L-tyrosine catalyzed by tyrosine phenol lyase (TPL).

DETAILED DESCRIPTION OF THE PRESENT INVENTION

1 Definitions

Unless expressly defined otherwise, technical and scientific terms used in this disclosure have the meanings that are commonly understood by people skilled in the art.

"Protein", "polypeptide" and "peptide" are used interchangeably herein to denote a polymer of at least two amino acids covalently linked by an amide bond, regardless of length or post-translational modification (e.g., glycosylation, phosphorylation, Lipidation, myristoylation, ubiquitination, etc.). This definition includes D-amino acids and L-amino acids, as well as mixtures of D-amino acids and L-amino acids.

"Engineered tyrosine phenol-lyase", "engineered tyrosine phenol-lyase polypeptide", "engineered TPL polypeptide", "improved tyrosine phenol-lyase" and "engineered polypeptide" are used interchangeably herein.

"Cells" or "wet cells" refers to host cells which express a polypeptide or engineered polypeptide, including the wet cells obtained in the preparation procedures shown in Example 3 and Example 7.

"Polynucleotide" and "nucleic acid" are used interchangeably herein.

"Cofactor" as used herein refers to a non-protein compound that operates in conjunction with an enzyme in a catalytic reaction. As used herein, "cofactor" is intended to encompass the vitamin B6 family compounds pyridoxal-5'-phosphate (PLP), pyridoxine (pyridoxol, or PN), pyridoxal (PL), pyridoxamine (PM), pyridoxine phosphate (PNP), and pyridoxamine phosphate (PMP), which are sometimes also referred to as coenzymes.

"PLP", "pyridoxal phosphate", "pyridoxal 5'-phosphate", "PYP" and "P5P" are used interchangeably herein to refer to compounds that act as cofactors in enzyme-catalyzed reactions.

"Coding sequence" refers to that portion of a nucleic acid (e.g., a gene) that encodes an amino acid sequence of a protein.

"Naturally occurring" or "wild type" refers to the form found in nature. For example, a naturally occurring or wild-type polypeptide or polynucleotide sequence is a sequence that is present in an organism that can be isolated from sources in nature and which has not been intentionally modified by manual procedures.

"Recombinant" or "engineered" or "non-naturally occurring" when used with reference to, for example, a cell, nucleic acid or polypeptide, refers to a material or material corresponding to the native or native form of the material, that has been modified in a manner that would not otherwise exist in nature, or is identical thereto but produced or derived from synthetic material and/or by manipulation using recombinant techniques.

"Sequence identity" and "homology" are used interchangeably herein to refer to comparisons between polynucleotide sequences or polypeptide sequences ("sequence identity" is generally expressed as a percentage), and are determined by comparing two optimally aligned sequences over a comparison window, where the portion of the polynucleotide or polypeptide sequence in the comparison window may comprise additions or deletions (i.e., gaps) as compared to the reference sequence for optimal alignment of the two sequences. The percentage can be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those skilled in the art will appreciate that there are many established algorithms available to align two sequences. The optimal alignment of sequences for comparison can be conducted, for example, by the local homology algorithm of Smith and Waterman, 1981, Adv. Appl. Math. 2: 482, by the Homology alignment algorithm of Needleman and Wunsch, 1970, J. Mol. Biol. 48: 443, by the search for similarity method of Pearson and Lipman, 1988, Proc. Natl. Acad. Sci. USA 85: 2444, by computerized implementations of these algorithms (GAP, BESTFIT, FASTA, and TFASTA in the GCG Wisconsin Package) or by visual inspection (see generally, Current Protocols in Molecular Biology, FM Ausubel et al. eds., Current Protocols, a Joint Venture between Greene Publishing Associates, Inc. and John Wiley & Sons, Inc., (1995 Supplement) (Ausubel)). Examples of algorithms that are suitable for determining the percent sequence identity and percent sequence similarity are the BLAST and BLAST 2.0 algorithms, which are described in Altschul et al., 1990, J. Mol. Biol. 215: 403-410 and Altschul et al., 1977, Nucleic Acids Res. 3389-3402, respectively. Software for performing BLAST analysis is publicly available through the National Center for Biotechnology Information website. The algorithm involves first identifying high scoring sequence pairs (HSPs) by identifying short words of length W in the query sequence, which either match or satisfy some positive-valued threshold scores T when aligned with a word of the same length in the database sequence. T is referred to as, the neighborhood word score threshold (Altschul et al., Supra).

These initial neighborhood word hits serve as seeds for initiating searches to find longer HSPs that contain them. The word hits are then extended in both directions along each sequence for as far as the cumulative alignment score can be increased. For nucleotide sequences, the cumulative scores are calculated using the parameters M (reward score for matched pair of residues; always >0) and N (penalty score for mismatched residues; always <0). For amino acid sequences, a scoring matrix is used to calculate the cumulative score. The extension of the word hits in each direction are halted when: the cumulative alignment score falls off by the quality X from its maximum achieved value; the cumulative score goes 0 or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a word-length (W) of 11, the expected value (E) of 10, M=5, N=−4, and a comparison of both strands as a default value. For amino acid sequences, the BLASTP program uses as defaults the word-length (W) of 3, the expected value (E) of 10 and the BLOSUM62 scoring matrix (see Henikoff and Henikoff, 1989, Proc Natl Acad Sci USA 89: 10915). Exemplary determination of sequence alignments and % sequence identity can employ the BESTFIT or GAP programs in the GCG Wisconsin Software package (Accelrys, Madison WI), using the default parameters provided.

"Reference sequence" refers to a defined sequence used as a basis for sequence comparison. The reference sequence may be a subset of a larger sequence, for example, a full-length gene or a fragment of a polypeptide sequence. In general, a reference sequence is at least 20 nucleotides or amino acid residues in length, at least 25 residues in length, at least 50 residues in length, or the full length of the nucleic acid or polypeptide. Because two polynucleotides or polypeptides may each (1) comprise a sequence (i.e., a portion of the complete sequence) that is similar between two sequences, and (2) may further comprise sequences that is divergent between the two sequences, sequence comparisons between two (or more) polynucleotides or polypeptides are typically performed by comparing the sequences of the two polynucleotides or polypeptides over a "comparison window" to identify and compare local regions of sequence similarity. In some embodiments, a "reference sequence" is not intended to be limited to a wild-type sequence, and may comprise engineered or altered sequences. For example, "a reference sequence with alanine at the residue corresponding to X27 based on SEQ ID NO: 2" refers to a reference sequence wherein the corresponding residue at position X27 in SEQ ID NO: 2 which is lysine, has been altered to alanine.

A "comparison window" refers to a conceptual segment of at least about 20 contiguous nucleotide positions or amino acid residues, wherein the sequence may be compared to a reference sequence of at least 20 contiguous nucleotides or amino acids and wherein the portions of the sequence in the comparison window may comprise additions or deletions (i.e., gaps) of 20% or less as compared to a reference sequence (which does not comprise additions or deletions) for optimal alignment of the two sequences. The comparison window can be longer than 20 contiguous residues, and optionally include 30, 40, 50, 100 or more residues.

In the context of the numbering for a given amino acid or polynucleotide sequence, "corresponding to," "reference to" or "relative to" refers to the numbering of the residues of a specified reference when the given amino acid or polynucleotide sequence is compared to the reference sequence. In other words, the residue number or residue position of a given sequence is designated with respect to the reference sequence, rather than by the actual numerical position of the residue within the given amino acid or polynucleotide sequence. For example, a given amino acid sequence such as an engineered polypeptide can be aligned to a reference sequence by introducing gaps to optimize residue matches between the two sequences. In these cases, although there are gaps, the numbering of the residue in a given amino acid or polynucleotide sequence is made with respect to the reference sequence to which they have been aligned.

"Amino acid difference" or "residue difference" refers to the difference in amino acid residues at a position of a polypeptide sequence relative to the amino acid residue at a corresponding position in the reference sequence. The positions of amino acid differences are generally referred to herein as "Xn", where n refers to the corresponding position in the reference sequence on which the residue differences are based. For example, "a residue difference at position X27 as compared to SEQ ID NO: 2" refers to the difference in amino acid residues at the polypeptide position corresponding to position 27 of SEQ ID NO: 2. Thus, if the reference polypeptide of SEQ ID NO: 2 has a lysine at position 27, then "a residue difference at position X27 as compared to SEQ ID NO: 2" refers to an amino acid substitution of any residue other than lysine at the position of the polypeptide corresponding to position 27 of SEQ ID NO: 2. In most of the examples herein, the specific amino acid residue difference at the position is indicated as "XnY", wherein "Xn" specified to the corresponding position as described above, and "Y" is the single letter identifier of the amino acid found in the engineered polypeptide (i.e., a different residue than in the reference polypeptide). In some examples (e.g., in Table 1), the present disclosure also provides specific amino acid differences denoted by the conventional notation "AnB", where A is a single letter identifier of a residue in the reference sequence, "n" is the number of residue position in the reference sequence, and B is the single letter identifier for the residue substitution in the sequence of the engineered polypeptide. In some examples, an engineered polypeptide of this disclosure may comprise one or more amino acid residue differences relative to a reference sequence, which is indicated by a list of specific positions at which residue differences are present relative to a reference sequence.

"Deletion" refers to the modification of a polypeptide by removing one or more amino acids from a reference polypeptide. Deletions can include the removal of one or more amino acids, two or more amino acids, five or more amino acids, ten or more amino acids, fifteen or more amino acids, or twenty or more amino acids, up to 10% of the total number of amino acids of the enzyme, or up to 20% of the total number of amino acids making up the reference enzyme while retaining the TPL enzymatic activity of the engineered polypeptides and/or retaining the improved properties of the engineered polypeptides. Deletions may involve the internal portion and/or the terminal portion of the polypeptide. In various embodiments, deletions may include a contiguous segment or may be discontinuous.

"Insertion" refers to modification of a polypeptide by adding one or more amino acids from a reference polypeptide. In some embodiments, the engineered polypeptides disclosed herein comprises insertions of one or more amino acids to a naturally-occurring TPL polypeptide as well as insertions of one or more amino acids to other engineered polypeptides. It can be inserted in the internal portions of the polypeptide or inserted to the carboxyl or amino terminus.

The insertion can be a contiguous segment of amino acids or separated by one or more amino acids in naturally occurring or engineered polypeptides.

"Fragment" as used herein refers to a polypeptide having an amino terminal and/or carboxyl terminal deletion, but where the remaining amino acid sequence is identical to the corresponding position in the sequence. Fragments may be at least 10 amino acids long, at least 20 amino acids long, at least 50 amino acids long or longer, and up to 70%, 80%, 90%, 95%, 98% and 99% of the full-length engineered polypeptide.

An "isolated polypeptide" refers to a polypeptide that is substantially separated from other substances with which it is naturally associated, such as proteins, lipids, and polynucleotides. The term comprises polypeptides that have been removed or purified from their naturally occurring environment or expression system (e.g., in host cells or in vitro synthesis). Engineered polypeptides may be present in the cell, in the cell culture medium, or prepared in various forms, such as lysates or isolated preparations. As such, in some embodiments, the engineered polypeptide may be an isolated polypeptide.

"Chiral center" refers to a carbon atom connecting four different groups.

"Stereoselectivity" refers to the preferential formation of one stereoisomer over the other in a chemical or enzymatic reaction.

Stereoselectivity can be partial, with the formation of one stereoisomer is favored over the other; or it may be complete where only one stereoisomer is formed. When the stereoisomers are enantiomers, the stereoselectivity is referred to as enantioselectivity. The excess fraction of one enantiomer in a mixture of two enantiomers is usually optionally reported as "enantiomeric excess" (ee for short). The fraction, typically a percentage, is generally reported in the art as the enantiomeric excess (i.e., ee) derived therefrom according to the following formula: [major enantiomer−minor enantiomer]/[major enantiomer+minor enantiomer].

"Stereoisomers", "stereoisomeric forms" and similar expressions are used interchangeably herein to refer to all isomers resulting from a difference in orientation of atoms in their space only. It includes enantiomers and compounds that have more than one chiral center and are not mirror images of one another (i.e., diastereomers).

"Improved enzymatic properties" refers to an enzyme property that is better or more desirable for a specific purpose as compared to a reference, such as a wild-type tyrosine phenol-lyase of SEQ ID No: 2. Enzyme properties that are expected to be improved include, but are not limited to, enzyme activity (which can be expressed as a percentage of substrate conversion), thermal stability, solvent stability (e.g., stability against phenolic compounds), pH activity characteristics, cofactor requirements, tolerance to inhibitors (e.g., substrate or product inhibition), stereospecificity, and stereoselectivity.

"Conversion" refers to the enzymatic transformation of a substrate to the corresponding product. "Percent conversion" or "conversion" refers to the percentage of substrate that is converted to product within a period of time under the specified conditions in the reaction system. Thus, "enzymatic activity" or "activity" of a tyrosine phenol-lyase or engineered polypeptide can be expressed as the "percent conversion" of the substrate to the product. The conversion rate is generally calculated by determining the product concentration and the main substrate concentration in the reaction system through sampling: {product molar concentration}/{main substrate molar concentration+product molar concentration}. The main substrate here refers to the compound (II), phenol or catechol.

"Thermostable" means that an engineered polypeptide that retains similar activity after being exposed to an elevated temperature (e.g., 72° C. or higher) for a period of time (e.g., 2.5 hours or more) compared to a wild-type enzyme.

"Solvent-stable" or "solvent-tolerant" refers to an engineered polypeptide that maintains similar activity after being exposed to different concentrations (e.g., 5-99%) of a solvent (phenol, catechol, methanol, ethanol, isopropyl Propanol, dimethyl sulfoxide (DMSO), tetrahydrofuran, 2-methyltetrahydrofuran, acetone, toluene, butyl acetate, methyl tert-butyl ether, etc.) for a period of time (e.g., 0.5-24 hours).

"Suitable reaction conditions" refer to those conditions (e.g., enzyme loading, substrate loading, cofactor loading, temperature, pH, buffer, co-solvent, etc.) in the biocatalytic reaction solution, under which the engineered polypeptide of the present disclosure are capable of converting a substrate to a desired product compound. Exemplary "suitable reaction conditions" are provided in the present disclosure and illustrated by examples.

"Hydrocarbyl" refers to a straight or branched aliphatic hydrocarbon chain. The number of subscripts following the symbol "C" specifies the number of carbon atoms that a particular chain may contain. For example, "$C_1$-$C_8$" refers to a straight or branched chain hydrocarbyl group having 1 to 8 carbon atoms. Hydrocarbyl groups may optionally be substituted with one or more substituent groups. "Aryl" means a monovalent aromatic hydrocarbon group of 6 to about 20 carbon atoms. "Heteroaryl" and "heteroaromatic" refer to an aryl group in which one or more of the carbon atoms of the parent aromatic ring system is/are replaced by a heteroatom (O, N, or S). "Substituted", when used to modify a specified group, means that one or more hydrogen atoms of the specified group are replaced, each independently of one another, by identical or different substituents. "Substituted hydrocarbyl, aryl, or heteroaryl" refers to a hydrocarbyl, aryl, or heteroaryl group in which one or more hydrogen atoms are replaced by other substituents. "Optional" or "optionally" means that the described event or circumstance may or may not occur; for example, "optionally substituted aryl" refers to an aryl group that may or may not be substituted. This description includes both substituted aryl groups and unsubstituted aryl groups.

As used herein, "compound" refers to any compound encompassed by the structural formulas and/or chemical names indicated with the compounds disclosed herein. Compounds may be identified by their chemical structure and/or chemical name. When the chemical structure and chemical name conflict, the chemical structure determines the identity of the compound. Unless specifically stated or indicated otherwise, the chemical structures described herein encompass all possible isomeric forms of the described compounds.

2 Engineering Peptides

Table 1 below illustrates the engineered TPL polypeptides developed by the present invention. Each row gives the polynucleotide sequence number and amino acid sequence number of a particular engineered polypeptide, as well as the residue difference compared to SEQ ID No: 2. The level of catalytic performance of each exemplified engineered polypeptide (the overall performance of the enzyme in the reaction, including but not limited to stability, activity in the reaction system, stereoselectivity to the product, etc.) is indicated by "+", with the specific meanings given in Table 2 or Table 3.

TABLE 1

| Polynucleotide SEQ ID No | Amino acid SEQ ID No | Residue difference relative to SEQ ID No: 2 | Catalytic performance |
|---|---|---|---|
| 1 | 2 | — | # |
| 3 | 4 | K27A; | + |
| 5 | 6 | K132R; | + |
| 7 | 8 | D454E; | + |
| 9 | 10 | K27A; I43T; K132R; E354P; | + |
| 11 | 12 | A118L; K132R; E354P; | + |
| 13 | 14 | I43T; A118L; K132R; E354P; D454E; | + |
| 15 | 16 | K27A; I43T; E354P; D454E; | + |
| 17 | 18 | E354P; | + |
| 19 | 20 | I43T; K132L; E354P; | + |
| 21 | 22 | K27A; I43T; E354P; | + |
| 23 | 24 | K132R; E354P; | + |
| 25 | 26 | K132R; E354P; D454E; | + |
| 27 | 28 | A118L; E354P; D454E; | + |
| 29 | 30 | V284A; | + |
| 31 | 32 | K41R; | + |
| 33 | 34 | I384V; | + |
| 35 | 36 | I10T; | + |
| 37 | 38 | C179S; | + |
| 39 | 40 | H343A; | + |
| 41 | 42 | F448H; | + |
| 43 | 44 | F449M; | + |
| 45 | 46 | H343R; | + |
| 47 | 48 | F449V; | + |
| 49 | 50 | D327A; | + |
| 51 | 52 | D327E; | + |
| 53 | 54 | Y128L; K132R; E354P; D454E; | ++ |
| 55 | 56 | Y128I; K132R; E354P; D454E; | ++ |
| 57 | 58 | Y128V; K132R; E354P; D454E; | ++ |
| 59 | 60 | Y128W; K132R; E354P; D454E; | ++ |
| 61 | 62 | K132R; V136T; E354P; D454E; | ++ |
| 63 | 64 | K132R; V136I; E354P; D454E; | ++ |
| 65 | 66 | K132R; L186N; E354P; D454E; | ++ |
| 67 | 68 | K132R; I140V; E354P; D454E; | ++ |
| 69 | 70 | K132R; H146L; E354P; D454E; | ++ |
| 71 | 72 | K132R; I140L; E354P; D454E; | ++ |
| 73 | 74 | K132R; H146E; E354P; D454E; | ++ |
| 75 | 76 | K132R; M288G; E354P; D454E; | ++ |
| 77 | 78 | K132R; M288L; E354P; D454E; | ++ |
| 79 | 80 | K132R; M288A; E354P; D454E; | ++ |
| 81 | 82 | K132R; E354P; M379G; D454E; | ++ |
| 83 | 84 | K132R; M288F; E354P; D454E; | ++ |
| 85 | 86 | K132R; M288H; E354P; D454E; | ++ |
| 87 | 88 | K132R; E354P; L446N; D454E; | ++ |
| 89 | 90 | K132R; F137A; E354P; D454E; | ++ |
| 91 | 92 | K132R; E354P; F448K; D454E; | ++ |
| 93 | 94 | K132R; E354P; F448M; D454E; | ++ |
| 95 | 96 | K132R; E354P; H396P; D454E; | ++ |
| 97 | 98 | Y128H; K132R; M288A; E354P; D454E; | +++ |
| 99 | 100 | Y128I; K132R; M288A; E354P; D454E; | +++ |
| 101 | 102 | K27A; I43T; K132R; V136T; I140V; M288A; E354P; D454E; | +++ |
| 103 | 104 | K132R; V136T; I140V; M288A; E354P; D454E; | +++ |
| 105 | 106 | K27A; K132R; V136T; M288A; E354P; D454E; | +++ |
| 107 | 108 | K132R; V136T; M288A; E354P; D454E; | +++ |
| 109 | 110 | K27A; I43T; K132R; V136T; M288A; E354P; D454E; | +++ |
| 111 | 112 | K27A; I43T; Y128W; K132R; M288A; E354P; D454E; | +++ |

TABLE 1-continued

| Polynucleotide SEQ ID No | Amino acid SEQ ID No | Residue difference relative to SEQ ID No: 2 | Catalytic performance |
|---|---|---|---|
| 113 | 114 | Y128I; K132R; V136T; I140V; L186N; M288A; E354P; D454E; | +++ |
| 115 | 116 | K27E; I43T; K132R; V136M; I140V; M288A; E354P; D454E; | +++ |
| 117 | 118 | K27A; I43T; K132R; I140V; M288A; E354P; D454E; | +++ |
| 119 | 120 | K132R; I140V; M288A; E354P; D454E; | +++ |
| 121 | 122 | I43T; K132R; V136T; M288A; E354P; D454E; | +++ |
| 123 | 124 | K27E; K132R; L186I; M288A; E354P; D454E; | +++ |
| 125 | 126 | K27A; Y128W; K132R; V136T; M288A; E354P; D454E; | +++ |
| 127 | 128 | K27A; K132R; V136T; I140V; M288A; E354P; D454E; | +++ |
| 129 | 130 | Y128I; K132R; I140V; M288A; E354P; D454E; | +++ |
| 131 | 132 | I43T; K132R; M288A; E354P; D454E; | +++ |
| 133 | 134 | K27A; I43T; K132R; M288A; E354P; D454E; | +++ |
| 135 | 136 | K27A; K132R; I140V; M288A; E354P; D454E; | +++ |
| 137 | 138 | K132R; M288A; E354P; F449Y; D454E; | +++ |
| 139 | 140 | K132R; M288S; E354P; D454E; | +++ |
| 141 | 142 | Y3C; K27A; I43T; K132R; V136T; I140V; M288A; E354P; Y414R; D454E; | ++++ |
| 143 | 144 | Y3F; K27A; I43T; K132R; V136T; I140V; M288A; E354P; D454E; | ++++ |
| 145 | 146 | K27A; I43T; Y128L; K132R; V136T; I140V; M288A; E354P; D454E; | ++++ |
| 147 | 148 | K27A; I43T; Y128R; K132R; V136T; I140V; M288A; E354P; D454E; | ++++ |
| 149 | 150 | K27A; I43T; K132L; V136T; I140V; M288A; E354P; D454E; | ++++ |
| 151 | 152 | K27A; I43T; K132N; V136T; I140V; M288A; E354P; D454E; | ++++ |
| 153 | 154 | K27A; I43T; K59H; K132R; V136T; I140V; M288A; E354P; D454E; | ++++ |
| 155 | 156 | K27A; I43T; K132R; V136T; I140V; M288A; E354P; D418N; D454E; | ++++ |
| 157 | 158 | K27A; I43T; K132R; V136T; I140V; M288F; E354P; D454E; | ++++ |
| 159 | 160 | K27A; I43T; K132R; V136T; I140V; M288L; E354P; D454E; | ++++ |
| 161 | 162 | K27A; I43T; M66L; K132R; V136T; I140V; M288A; E354P; D454E; | ++++ |
| 163 | 164 | K27A; I43T; K132R; V136T; I140V; E233K; M288A; E354P; D454E; | ++++ |
| 165 | 166 | K27A; I43T; K132R; V136T; I140V; E233H; M288A; E354P; D454E; | ++++ |
| 167 | 168 | K27A; I43T; K132R; V136T; I140V; E233Q; M288A; E354P; D454E; | ++++ |
| 169 | 170 | K27A; I43T; K132R; V136T; I140V; M288A; E354P; Q429D; D454E; | ++++ |
| 171 | 172 | K27A; Y33W; I43T; K132R; V136T; I140V; M288A; E354P; D454E; | ++++ |
| 173 | 174 | K27A; N39K; I43T; K132R; V136T; I140V; M288A; E354P; D454E; | ++++ |

TABLE 1-continued

| Polynucleotide SEQ ID No | Amino acid SEQ ID No | Residue difference relative to SEQ ID No: 2 | Catalytic performance |
|---|---|---|---|
| 175 | 176 | K27A; N39Y; I43T; K132R; V136T; I140V; M288A; E354P; D454E; | ++++ |
| 177 | 178 | K27A; N39R; I43T; K132R; V136T; I140V; M288A; E354P; D454E; | ++++ |
| 179 | 180 | K27A; I43T; K132R; V136T; I140V; M288A; E354P; Q445G; D454E; | ++++ |
| 181 | 182 | K27R; I43T; K132R; V136T; I140V; M288A; E354P; D454E; | ++++ |
| 183 | 184 | K27A; I43T; K132R; V136T; I140V; F212Y; M288A; E354P; D454E; | ++++ |
| 185 | 186 | K27A; I43T; K132R; V136T; I140V; M253H; M288A; E354P; D454E; | ++++ |
| 187 | 188 | K27A; I43T; K132R; V136T; I140V; G255P; M288A; E354P; D454E; | ++++ |
| 189 | 190 | K27A; N39K; I43T; Y128R; K132R; V136T; I140V; E233Q; M288A; E354P; D454E; | +++++ |
| 191 | 192 | K27R; N39K; I43T; Y128R; K132R; V136T; I140V; M288A; E354P; D454E; | +++++ |
| 193 | 194 | K27R; N39K; I43T; K132R; V136T; I140V; F212Y; E233Q; M288A; E354P; Q445G; D454E; | +++++ |
| 195 | 196 | K27N; N39K; I43T; K132R; V136T; I140V; F212Y; M288A; E354P; D454E; | +++++ |
| 197 | 198 | K27N; N39K; I43T; Y128R; K132R; V136T; I140V; F212Y; M288A; E354P; D454E; | +++++ |
| 199 | 200 | K27N; N39K; I43T; Y128R; K132R; V136T; I140V; E233Q; M288A; E354P; D454E; | +++++ |
| 201 | 202 | K27N; N39K; I43T; K132R; V136T; I140V; M288A; E354P; D454E; | +++++ |
| 203 | 204 | K27R; N39K; I43T; K132R; V136T; I140V; M288A; E354P; D454E; | +++++ |
| 205 | 206 | K27N; N39K; K41S; I43T; K132R; V136T; I140V; M288A; E354P; D454E; | +++++ |
| 207 | 208 | K27T; N39K; K41T; I43T; K132R; V136T; I140V; M288A; E354P; D454E; | +++++ |
| 209 | 210 | K27N; N39K; K41R; I43T; K132R; V136T; I140V; M288A; E354P; D454E; | +++++ |
| 211 | 212 | K27Q; K41Q; I43T; K132R; V136T; I140V; M288A; E354P; D454E; | +++++ |
| 213 | 214 | K27R; N39H; K41T; I43T; K132R; V136T; I140V; M288A; E354P; D454E; | +++++ |
| 215 | 216 | K27H; N39K; K41T; I43T; K132R; V136T; I140V; M288A; E354P; D454E; | +++++ |
| 217 | 218 | N39K; I43T; K132R; V136T; I140V; M288A; E354P; D454E; | +++++ |
| 219 | 220 | K27R; N39K; K41Q; I43T; K132R; V136T; I140V; M288A; E354P; D454E; | +++++ |
| 221 | 222 | K27N; N39R; K41N; I43T; K132R; V136T; I140V; M288A; E354P; D454E; | +++++ |
| 223 | 224 | K27S; I43T; K132R; V136T; I140V; M288A; E354P; D454E; | +++++ |
| 225 | 226 | K27H; K41R; I43T; K132R; V136T; I140V; M288A; E354P; D454E; | +++++ |
| 227 | 228 | K27N; N39R; I43T; K132R; V136T; I140V; M288A; E354P; D454E; | +++++ |
| 229 | 230 | K27Q; N39R; K41A; I43T; K132R; V136T; I140V; M288A; E354P; D454E; | +++++ |
| 231 | 232 | K27N; K41H; I43T; K132R; V136T; I140V; M288A; E354P; D454E; | +++++ |
| 233 | 234 | K27R; N39R; K41Q; I43T; K132R; V136T; I140V; M288A; E354P; D454E; | +++++ |
| 235 | 236 | K27T; N39K; I43T; K132R; V136T; I140V; M288A; E354P; D454E; | +++++ |
| 237 | 238 | K27N; N39R; K41A; I43T; K132R; V136T; I140V; M288A; E354P; D454E; | +++++ |
| 239 | 240 | N39K; K41A; I43T; K132R; V136T; I140V; M288A; E354P; D454E; | +++++ |
| 241 | 242 | K27N; K41R; I43T; K132R; V136T; I140V; M288A; E354P; D454E; | +++++ |
| 243 | 244 | K27A; N39K; K41H; I43T; K132R; V136T; I140V; M288A; E354P; D454E; | +++++ |
| 245 | 246 | N39R; K41N; I43T; K132R; V136T; I140V; M288A; E354P; D454E; | +++++ |
| 247 | 248 | N39R; I43T; K132R; V136T; I140V; M288A; E354P; D454E; | +++++ |
| 249 | 250 | K27S; N39R; K41N; I43T; K132R; V136T; I140V; M288A; E354P; D454E; | +++++ |
| 251 | 252 | K27R; N39K; K41S; I43T; K132R; V136T; I140V; M288A; E354P; D454E; | +++++ |
| 253 | 254 | K27A; N39K; K41R; I43T; K132R; V136T; I140V; M288A; E354P; D454E; | +++++ |
| 255 | 256 | K27A; N39K; I43T; A72C; K132R; V136T; I140V; M288A; E354P; D454E; | +++++ |
| 257 | 258 | K27A; N39 K; I43T; Y78T; K132R; V136T; I140V; M288A; E354P; D454E; | +++++ |
| 259 | 260 | K27R; N39K; I43T; K132R; V136T; I140V; E233Q; M288A; E354P; D454E; | +++++ |
| 261 | 262 | K27Q; N39K; I43T; K132R; V136T; I140V; M288A; E354P; D454E; | +++++ |
| 263 | 264 | K27R; N39K; I43T; K132R; V136T; I140V; M288A; E354P; Q445G; D454E; | +++++ |
| 265 | 266 | K27A; N39K; I43T; K132R; V136T; I140V; F212Y; M288A; E354P; D454E; | +++++ |
| 267 | 268 | K27R; N39R; I43T; K132R; V136T; I140V; M288A; E354P; D454E; | +++++ |
| 269 | 270 | K27T; N39 K; K41Q; I43T; K132R; V136T; I140V; M288A; E354P; D454E; | +++++ |
| 271 | 272 | K27A; N39K; I43T; E75Q; K132R; V136T; I140V; M288A; E354P; D454E; | +++++ |
| 273 | 274 | S17R; K27A; Q29K; N39K; I43T; K132R; V136T; I140V; M288A; E354P; V391K; D454E; | +++++ |

TABLE 1-continued

| Polynucleotide SEQ ID No | Amino acid SEQ ID No | Residue difference relative to SEQ ID No: 2 | Catalytic performance |
|---|---|---|---|
| 275 | 276 | K27A; Q29K; N39K; I43T; K132R; V136T; I140V; N174K; M288A; E354P; D454E; | +++++ |
| 277 | 278 | S17R; K27A; N39K; I43T; K132R; V136T; I140V; M288A; E354P; N390K; D454E; | +++++ |
| 279 | 280 | S17R; K27A; N39K; I43T; K132R; V136T; I140V; N174K; A206K; M288A; E354P; D454E; | +++++ |
| 281 | 282 | K27A; N39K; I43T; K132R; V136T; I140V; N174K; A206K; M288A; E354P; D454E; | +++++ |
| 283 | 284 | S17R; K27A; N39K; I43T; K132R; V136T; I140V; A206K; M288A; E354P; N390K; V391K; D454E; | +++++ |
| 285 | 286 | S17R; K27A; Q29K; N39K; I43T; K132R; V136T; I140V; N174K; A206K; M288A; E354P; N390K; D454E; | +++++ |
| 287 | 288 | K27A; N39K; I43T; E75R; K132R; V136T; I140V; E280N; M288A; E354P; Q445T; D454E; | +++++ |
| 289 | 290 | K27A; N39K; K41D; I43T; E75R; K132R; V136T; I140V; S276E; E280N; M288A; E354P; Q445Y; D454E; | +++++ |
| 291 | 292 | K27A; N39K; K41D; I43T; E75R; K132R; V136T; I140V; S276E; M288A; E354P; Q445T; D454E; | +++++ |
| 293 | 294 | K27A; N39K; I43T; K132R; V136T; I140V; M288A; E354P; Q445Y; D454E; | +++++ |
| 295 | 296 | K27A; N39K; I43T; E75R; K132R; V136T; I140V; M288A; E354P; Q445T; D454E; | +++++ |
| 297 | 298 | K27A; N39K; I43T; E75K; K132R; V136T; I140V; S276E; E280N; M288A; E354P; D454E; | +++++ |
| 299 | 300 | K27A; N39K; I43T; E75R; K132R; V136T; I140V; S276E; E280N; M288A; E354P; Q445T; D454E; | +++++ |
| 301 | 302 | K27A; N39K; K41E; I43T; E75K; K132R; V136T; I140V; S276E; M288A; E354P; Q445Y; D454E; | +++++ |
| 303 | 304 | K27A; N39K; K41E; I43T; E75R; K132R; V136T; I140V; S276E; E280N; M288A; E354P; Q445T; D454E; | +++++ |
| 305 | 306 | K27A; N39K; I43T; E75K; K132R; V136T; I140V; E280N; M288A; E354P; Q445T; D454E; | +++++ |
| 307 | 308 | K27A; N39K; I43C; K132R; V136T; I140V; M288A; E354P; D454E; | +++++ |

TABLE 2

| Catalytic performance of the enzyme | Description | Reaction conditions of screening assay |
|---|---|---|
| # | Conversion < 1% | Enzyme solution 20%(v/v), phenol 20 g/L, sodium pyruvate 25 g/L, ammonium acetate 18 g/L, 0.2 mM PLP, 0.1M TEOA, pH8.5, 40° C. reaction time: 24 h |
| + | Conversion ≥ 1%, ee ≥ 99.5% | Enzyme solution 20%(v/v), phenol 20 g/L, sodium pyruvate 25 g/L, ammonium acetate 18 g/L, 0.2 mM PLP, 0.1M TEOA, pH8.5, 40° C. reaction time: 24 h |
| ++ | Conversion ≥ 10%, ee ≥ 99.5% | Enzyme solution 20%(v/v), phenol 20 g/L, sodium pyruvate 25 g/L, ammonium acetate 18 g/L, 0.2 mM PLP, 0.1M TEOA, pH8.5, 40° C. reaction time: 24 h |
| +++ | Conversion ≥ 15%, ee ≥ 99.5% | Enzyme solution 20%(v/v), phenol 20 g/L, sodium pyruvate 25 g/L, ammonium acetate 18 g/L, 0.2 mM PLP, 0.1M TEOA, pH8.5, 40° C. reaction time: 24 h |
| ++++ | Conversion ≥ 20%, ee ≥ 99.5% | Enzyme solution 20%(v/v), phenol 20 g/L, sodium pyruvate 25 g/L, ammonium acetate 18 g/L, 0.2 mM PLP, 0.1M TEOA, pH8.5, 40° C. reaction time: 24 h |
| +++++ | Conversion ≥ 40%, ee ≥ 99.5% | Enzyme solution 20%(v/v), phenol 20 g/L, sodium pyruvate 25 g/L, ammonium acetate 18 g/L, 0.2 mM PLP, 0.1M TEOA, pH8.5, 40° C. reaction time: 24 h |

The preparation of the enzyme solution in the reaction conditions described in Table 2 refers to Example 3. The enzyme solution is not subjected to any pretreatment and contains equivalent amount of the polypeptide corresponding to the amino acid sequence in Table 1. The operation of the screening reactions in Table 2 can be referred to Example 4. The conversion here is calculated based on the molar ratio of phenol converted to L-tyrosine.

TABLE 3

| Catalytic performance of the enzyme | Description | Reaction conditions of screening assay |
|---|---|---|
| # | Conversion < 1% | [3 g/L phenol, 20 h] Pretreated enzyme solution 67% (v/v), phenol 11 g/L, sodium pyruvate 14 g/L, ammonium acetate 10 g/L, 0.2 mM PLP, 0.1M TEOA, pH8.5, 40° C. reaction time: 6 h |
| + | Conversion ≥ 5%, ee ≥ 99.5% | [3 g/L phenol, 20 h] Pretreated enzyme solution 67% (v/v), phenol 11 g/L, sodium pyruvate 14 g/L, ammonium acetate 10 g/L, 0.2 mM PLP, 0.1M TEOA, pH8.5, 40° C. reaction time: 6 h |
| ++ | Conversion ≥ 30%, ee ≥ 99.5% | [3 g/L phenol, 20 h] Pretreated enzyme solution 67% (v/v), phenol 11 g/L, sodium pyruvate 14 g/L, ammonium acetate 10 g/L, 0.2 mM PLP, 0.1M TEOA, pH8.5, 40° C. reaction time: 6 h |
| +++ | Conversion ≥ 40%, ee ≥ 99.5% | [3 g/L phenol, 20 h] Pretreated enzyme solution 67% (v/v), phenol 11 g/L, sodium pyruvate 14 g/L, ammonium acetate 10 g/L, 0.2 mM PLP, 0.1M TEOA, pH8.5, 40° C. reaction time: 6 h |
| +++ | Conversion ≥ 20%, ee ≥ 99.5% | [5 g/L phenol, 20 h] Pretreated enzyme solution 67% (v/v), phenol 11 g/L, sodium pyruvate 14 g/L, ammonium acetate 10 g/L, 0.2 mM PLP, 0.1M TEOA, pH8.5, 40° C. reaction time: 6 h |

TABLE 3-continued

| Catalytic performance of the enzyme | Description | Reaction conditions of screening assay |
|---|---|---|
| +++ | Conversion < 1% | [7 g/L phenol, 20 h] Pretreated enzyme solution 67% (v/v), phenol 11 g/L, sodium pyruvate 14 g/L, ammonium acetate 10 g/L, 0.2 mM PLP, 0.1M TEOA, pH8.5, 40° C. reaction time: 6 h |
| ++++ | Conversion ≥ 40%, ee ≥ 99.5% | [5 g/L phenol, 20 h] Pretreated enzyme solution 67% (v/v), phenol 11 g/L, sodium pyruvate 14 g/L, ammonium acetate 10 g/L, 0.2 mM PLP, 0.1M TEOA, pH8.5, 40° C. reaction time: 6 h |
| ++++ | Conversion ≥ 15%, ee ≥ 99.5% | [7 g/L phenol, 20 h] Pretreated enzyme solution 67% (v/v), phenol 11 g/L, sodium pyruvate 14 g/L, ammonium acetate 10 g/L, 0.2 mM PLP, 0.1M TEOA, pH8.5, 40° C. reaction time: 6 h |
| ++++ | Conversion < 1% | [11 g/L phenol, 20 h] Pretreated enzyme solution 67% (v/v), phenol 11 g/L, sodium pyruvate 14 g/L, ammonium acetate 10 g/L, 0.2 mM PLP, 0.1M TEOA, pH8.5, 40° C. reaction time: 6 h |
| +++++ | Conversion ≥ 40%, ee ≥ 99.5% | [7 g/L phenol, 20 h] Pretreated enzyme solution 67% (v/v), phenol 11 g/L, sodium pyruvate 14 g/L, ammonium acetate 10 g/L, 0.2 mM PLP, 0.1M TEOA, pH8.5, 40° C. reaction time: 6 h |
| +++++ | Conversion ≥ 20%, ee ≥ 99.5% | [11 g/L phenol, 20 h] Pretreated enzyme solution 67% (v/v), phenol 11 g/L, sodium pyruvate 14 g/L, ammonium acetate 10 g/L, 0.2 mM PLP, 0.1M TEOA, pH8.5, 40° C. reaction time: 6 h |

The pretreated enzyme solution described in the reaction conditions in Table 3 is an enzyme solution obtained by treating the enzyme with different concentrations of phenol. The operation of such pretreatment can be referred to Example 5. The conversion here is calculated based on the molar ratio of phenol converted to L-tyrosine.

3 Polynucleotides, Control Sequences, Expression Vectors and Host Cells that can be Used to Produce Engineered Polypeptides In another aspect, the disclosure provides polynucleotides encoding engineered polypeptides having TPL activity (or an enzyme activity as of EC 4.1.99.2) described herein. The polynucleotide can be operably linked to one or more heterologous regulatory sequences that control gene expression to produce recombinant polynucleotides that are capable of expressing the engineered polypeptides. Expression constructs comprising a heterologous polynucleotide encoding an engineered polypeptide may be introduced into suitable host cell to express the corresponding engineered polypeptide.

As apparent to one skilled in the art, the availability of protein sequences and knowledge of codons corresponding to a variety of amino acids provide an illustration of all possible polynucleotides that encode the protein sequence of interest. The degeneracy of the genetic code, in which the same amino acid is encoded by selectable or synonymous codons, allows for the production of an extremely large number of polynucleotides, all of which encode the engineered polypeptides disclosed herein. Thus, upon determination of a particular amino acid sequence, one skilled in the art can generate any number of different polynucleotides by merely modifying one or more codons in a manner that does not alter the amino acid sequence of the protein. In this regard, this disclosure specifically contemplates each and every possible alteration of a polynucleotide that can be made by selecting a combination based on possible codon selections, for any of the polypeptides disclosed herein, comprising those amino acid sequences of exemplary engineered polypeptides listed in Table 1, and any of the polypeptides disclosed as even sequence identifiers of SEQ ID NO: 4 to 308 in the Sequence Listing incorporated by reference, all of which are believed to be particularly disclosed or public.

In various embodiments, the codons are preferably selected to accommodate the host cell in which the recombinant protein is produced. For example, codons preferred for bacteria are used to express genes in bacteria; codons preferred for yeast are used to express genes in yeast; and codons preferred for mammals are used for gene expression in mammalian cells.

In some embodiments, the polynucleotides encode polypeptides comprising amino acid sequences that are at least about 80%, 81%, 82%, 83%, 84%, 85%, 86%, 87%, 88%, 89%, 90%, 91%, 92%, 93%, 94%, 95%, 96%, 97%, 98%, 99% or more identical to a reference sequence that is an even sequence identifier of SEQ ID No: 4-308, wherein the polypeptides have TPL activity and one or more of the improved properties described herein, for example, the ability to catalyze the synthesis of L-tyrosine or L-DOPA with increased stability and/or activity compared to the polypeptide of SEQ ID No: 2.

In some embodiments, the polynucleotides encode engineered polypeptides comprising amino acid sequences having a percentage of identity described above and having one or more amino acid residue differences as compared to SEQ ID No: 2. In some embodiments, the present disclosure provides engineered polypeptides having TPL activity, wherein the engineered polypeptides comprise a combination that has at least 80% sequence identity to the reference sequence of SEQ ID No: 2 with residue differences that is selected from the following positions: X3, X10, X17, X27, X29, X33, X39, X41, X43, X59, X66, X72, X75, X78, X118, X128, X132, X136, X137, X140, X146, X174, X179, X186, X206, X212, X233, X253, X255, X276, X280, X284, X288, X327, X343, X354, X379, X384, X390, X391, X396, X414, X418, X429, X445, X446, X448, X449, X454.

In some embodiments, the polynucleotides encoding the engineered polypeptide comprise sequences having odd sequence identifiers of SEQ ID No: 3-307.

In some embodiments, the polynucleotides encode polypeptides as described herein, but at the nucleotide level, the polynucleotides have about 50%, 55%, 60%, 65%, 70%, 75%, 80%, 85%, 86%, 87%, 88%, 89%, 90%, 91%, 92%, 93%, 94%, 95%, 96%, 97%, 98% or 99% or more sequence identity to reference polynucleotides encoding engineered polypeptide. In some embodiments, the reference polynucleotides are selected from the sequences having the odd sequence identifiers of SEQ ID No: 3-307.

The isolated polynucleotides encoding engineered polypeptides can be manipulated to enable the expression of the engineered polypeptides in a variety of ways, which comprises further modification of the sequences by codon optimization to improve expression, insertion into suitable expression elements with or without additional control sequences, and transformation into a host cell suitable for expression and production of the engineered polypeptides.

Depending on the expression vector, manipulation of the isolated polynucleotide prior to insertion of the isolated polynucleotide into the vector may be desirable or necessary. Techniques for modifying polynucleotides and nucleic acid sequences using recombinant DNA methods are well known in the art. Guidance is provided below: Sambrook et al., 2001, MolecuLar Cloning: A Laboratory Manual, Third Edition, Cold Spring Harbor Laboratory Press; and Current Protocols in MolecuLar Biology, Edited by Ausubel. F. et al., GreenePub. Associates, 1998, 2010.

In another aspect, this disclosure also relates to recombinant expression vectors, depending on the type of host they are to be introduced into, including a polynucleotide encoding an engineered polypeptide or variant thereof, and one or more expression regulatory regions, such as promoters and terminators, origin of replication and the like. Alternatively, the nucleic acid sequence of the present disclosure can be expressed by inserting the nucleic acid sequence or the nucleic acid construct comprising the sequence into an appropriate expression vector. In generating the expression vector, the coding sequence is located in the vector such that the coding sequence is linked to a suitable control sequence for expression.

The recombinant expression vector can be any vector (e.g., a plasmid or virus) that can be conveniently used in recombinant DNA procedures and can result in the expression of a polynucleotide sequence. The choice of vector will generally depend on the compatibility of the vector with the host cell to be introduced into. The vector can be linear or closed circular plasmid. The expression vector may be an autonomously replicating vector, i.e., a vector that exists as an extrachromosomal entity whose replication is independent of chromosomal replication such as plasmids, extrachromosomal elements, minichromosomes, or artificial chromosomes. The vector may contain any elements for ensuring self-replication. Alternatively, the vector may be a vector that, when introduced into a host cell, integrates into the genome and replicates with the chromosome into which it is integrated. Moreover, a single vector or plasmid or two or more vectors or plasmids that together comprise the total DNA to be introduced into the genome of the host cell may be used.

Many expression vectors useful to the embodiments of the present disclosure are commercially available. An exemplary expression vector can be prepared by inserting a polynucleotide encoding an engineered polypeptide to plasmid pACYC-Duet-1 (Novagen).

In another aspect, this disclosure provides host cells comprising polynucleotides encoding engineered polypeptides of the present disclosure. The polynucleotide is linked to one or more control sequences for expression of polypeptide in a host cell. Host cells for expression of polypeptides encoded by the expression vectors of the present disclosure are well known in the art, including, but not limited to, bacterial cells such as *E. coli*, *Arthrobacter* KNK168, *Streptomyces*, and *Salmonella typhimurium* cells; fungal cells such as yeast cells (e.g., *Saccharomyces cerevisiae* or *Pichia pastoris*); insect cells such as *Drosophila* S2 and *Spodoptera* Sf9 cells; animal cells such as CHO, COS, BHK, 293 and Bowes melanoma cells; and plant cells. An exemplary host cell is *E. coli* BL21 (DE3). The above host cells may be wild-type or may be engineered cells through genomic edition, such as knockout of the wild type TPL gene carried in the host cell's genome. Suitable media and growth conditions for the above host cells are well known in the art.

Polynucleotides used to express engineered polypeptides can be introduced into cells by a variety of methods known in the art. Techniques comprise, among others, electroporation, bio-particle bombardment, liposome-mediated transfection, calcium chloride transfection, and protoplast fusion. Different methods of introducing polynucleotides into cells are obvious to those skilled in the art.

4 Process of Producing an Engineered Polypeptide

Engineered polypeptides can be obtained by subjecting a polynucleotide encoding a TPL to mutagenesis and/or directed evolution methods. An exemplary directed evolution technique can be found in "Biocatalysis for the Pharmaceutical Industry: Discovery, Development, and Manufacturing" (2009 John Wiley & Sons Asia (Pte) Ltd. ISBN: 978-0-470-82314-9).

When the sequence of an engineered polypeptide is known, the encoding polynucleotide may be prepared by standard solid-phase methods according to known synthetic methods. In some embodiments, fragments of up to about 100 bases can be synthesized separately and then ligated (e.g., by enzymatic or chemical ligation methods or polymerase-mediated methods) to form any desired contiguous sequence. For example, the polynucleotides and oligonucleotides of the present disclosure can be prepared by chemical synthesis using, for example, the classic phosphoramidite method described by Beaucage et al., 1981, TetLett 22: 1859-69, or Matthes et al. Human, 1984, EMBOJ. 3: 801-05, as typically practiced in automated synthesis methods. According to the phosphoramidite method, oligonucleotides are synthesized, purified, annealed, ligated, and cloned into suitable vectors, for example, in an automated DNA synthesizer. In addition, essentially any nucleic acid is available from any of a variety of commercial sources.

In some embodiments, the present disclosure also provides a process for preparing or producing an engineered polypeptide, wherein the process comprises culturing a host cell capable of expressing a polynucleotide encoding the engineered polypeptide under culture conditions suitable for the expression of the polypeptide. In some embodiments, the process of preparing a polypeptide further comprises isolating the polypeptide. Engineered polypeptides may be expressed in suitable cells and isolated (or recovered) from the host cell and/or culture medium using any one or more of the well-known techniques for protein purification, the techniques for protein purification include, among others, lysozyme treatment, sonication, filtration, salting out, ultracentrifugation, and chromatography.

5 Methods of Using Engineered Polypeptides and Compounds Prepared Therewith

In another aspect, the engineered polypeptides described herein can catalyze the synthesis of a chiral amino acid compound. The present disclosure also provides process of preparing a wide range of compounds (I) or structural analogs thereof using the engineered polypeptides disclosed herein. In some embodiments, engineered polypeptides can be used in a process of preparing a compound of formula (I):

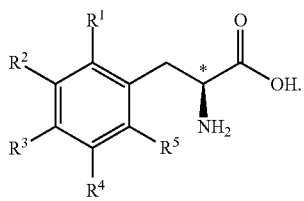

(I)

The amino acid product of formula (I) has the indicated stereochemical configuration at the chiral center marked with an *; the amino acid product of formula (I) is in enantiomeric excess over the other isomer, wherein $R^1$, $R^2$, $R^3$, $R^4$ or $R^5$ are optionally substituted or unsubstituted $C_1$-$C_6$ hydrocarbyl, —H, halogen (such as —F, —Cl, —Br and —I), —OH, alkenyl, alkynyl, aryl, heteroaryl, —$NO_2$, —NO, —$SO_2R'$ or —SOR', —SR', —NR'R', —OR', —$CO_2R'$ or —COR', —C(O)NR', —$SO_2$ $NH_2$ or —SO $NH_2$, —CN, —$CF_3$; wherein each R' is independently selected from —H, ($C_1$-$C_4$) hydrocarbyl, halogen, $C_1$-$C_8$ hydrocarbyl, $C_2$-$C_{12}$ alkenyl, $C_2$-$C_{12}$ alkynyl, cycloalkyl, aryl or heterocyclic. The process comprises that, under suitable reaction conditions, in the presence of pyruvate and ammonia or in the presence of serine, the substrate of formula (II)

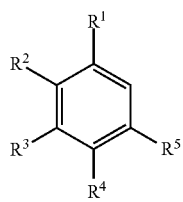

(II)

is contacted with an engineered polypeptide as described herein.

In some embodiments, the engineered polypeptide has at least 80%, 81%, 82%, 83%, 84%, 85%, 86%, 87%, 88%, 89%, 90%, 91%, 92%, 93%, 94%, 95%, 96%, 97%, 98%, 99% or more of sequence identity to the even sequence identifiers of SEQ ID NO: 2-308, and are capable of catalyzing the synthesis of the product of formula (I) with better performance (including better stability, higher activity, or tolerance to higher substrate concentration) compared to SEQ ID NO: 2.

In some embodiments, the product of formula (I) is produced in an enantiomeric excess of at least 90%, 91%, 92%, 93%, 94%, 95%, 96%, 97%, 98%, or 99% or more.

As mentioned above, engineered polypeptides useful in the process of the present disclosure may be characterized according to their ability to catalyze the synthesis of L-tyrosine. Thus, in any of the embodiments of the process disclosed herein, the process may be carried out, wherein the engineered polypeptides are capable of catalyzing the synthesis of L-tyrosine with better performance than SEQ ID NO: 2 and have at least 80%, 81%, 82%, 83%, 84%, 85%, 86%, 87%, 88%, 89%, 90%, 91%, 92%, 93%, 94%, 95%, 96%, 97%, 98%, 99% or more of sequence identity to the even sequence identifiers of SEQ ID No: 2-308.

In some embodiments of the process, the product of formula (I) is:

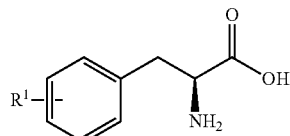

where $R^1$ is as defined above, and the substrate of formula (II) is:

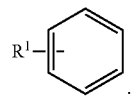

In some embodiments, $R^1$ is in the para position of the phenyl ring. In some embodiments, $R^1$ is in the meta position of the phenyl ring. In some embodiments, $R^1$ is ortho to the phenyl ring. In some embodiments, $R^1$ is in both the para and meta positions of the phenyl ring. In some embodiments, $R^1$ is both para and ortho to the phenyl ring. In some embodiments, $R^1$ is in both the meta and ortho positions of the phenyl ring.

Specific embodiments of the engineered polypeptides for use in the above processes are further provided in the detailed description. The engineered polypeptides that can be used in the above processes comprise amino acid sequences selected from SEQ ID No: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308.

In some embodiments, the engineered polypeptides disclosed herein can be used in process of preparing L-tyrosine:

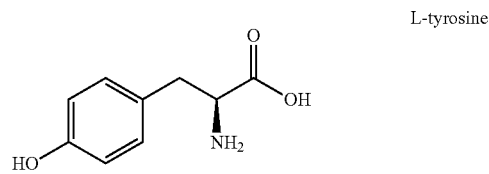 [SMILES: N[C@@H](Cc1ccc(O)cc1)C(=O)O]

L-tyrosine

In these embodiments, the process comprises, under suitable reaction conditions, in the presence of pyruvate and ammonia or in the presence of serine, the compound of formula A1 phenol

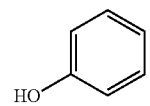

A1 is contacted with the engineered polypeptide disclosed herein.

In some embodiments, the engineered polypeptides disclosed herein can be used in process of preparing L-DOPA:

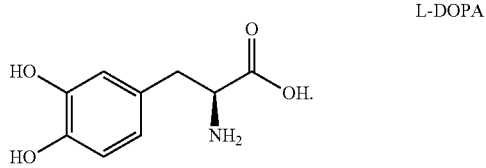 [SMILES: N[C@@H](Cc1ccc(O)c(O)c1)C(=O)O]

L-DOPA

In these embodiments, the process comprises, under suitable reaction conditions, in the presence of pyruvate and ammonia or in the presence of serine, the compound of formula A2 catechol:

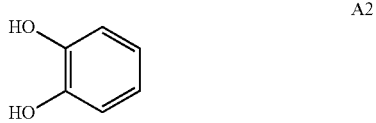

A2 is contacted with the engineered polypeptide disclosed herein.

In some embodiments of the above processes, L-tyrosine or L-DOPA is produced in an enantiomeric excess of at least 90%, 91%, 92%, 93%, 94%, 95%, 96%, 97%, 98% or 99% or more.

Specific embodiments of the engineered polypeptides for use in the above processes are further provided in the detailed description. The engineered polypeptides that can be used in the above processes comprise amino acid sequences selected from SEQ ID No: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308. In some embodiments, the engineered polypeptide has at least 80%, 81%, 82%, 83%, 84%, 85%, 86%, 87%, 88%, 89%, 90%, 91%, 92%, 93%, 94%, 95%, 96%, 97%, 98%, 99% or more of sequence identity to the even sequence identifiers of SEQ ID No: 2-308, and are capable of catalyzing the synthesis of L-tyrosine or L-DOPA with better performance (including better stability, higher activity, or tolerance to higher substrate concentration) compared to SEQ ID NO: 2.

As described herein and exemplified in the examples, the present disclosure contemplates a range of suitable reaction conditions that may be used in the process herein, including but not limited to cofactor loading, temperature, solvent system, loading of each reaction component, polypeptide loading, buffers, pH, and reaction time. Additional suitable reaction conditions for performing a process of catalyzing the conversion of a substrate compound into a product compound using the engineered polypeptides described herein can be easily optimized by routine experimentation, which includes but is not limited to the engineered polypeptide being contacted with substrate compounds under experimental reaction conditions of varying the loading of individual reaction components, pH, temperature, solvent conditions, cofactor concentration, and the product compound being detected, for example, using the methods described in the Examples provided herein.

As described above, engineered polypeptides having TPL activity for use in the process of the present disclosure generally comprise amino acid sequences that have at least 80%, 81%, 82%, 83%, 84%, 85%, 86%, 87%, 88%, 89%, 90%, 91%, 92%, 93%, 94%, 95%, 96%, 97%, 98%, 99% or more sequence identity to the reference amino acid sequence selected from any one of the even numbered sequences of SEQ ID No: 2-308.

The loading of substrate compounds in the reaction mixture can be varied, taking into consideration of, for example, the amount of the desired product compound, the effect of the substrate concentration on the enzyme activity, the stability of the enzyme under the reaction conditions, and the conversion of substrate to product, and this variation can be proportional or not proportional. In order to convert the substrate of formula (II), A1, or A2 as completely as possible, the loading of pyruvate, ammonia, or serine in the reaction mixture may be excessive to the loading of substrate of formula (II), A1, or A2. The values for the substrate loading provided herein are based on the molecular weight of compound (II), A1, A2, pyruvate, ammonia, or serine. However, it is also contemplated that the equivalent molar amounts of various hydrates and/or salts of compound (II), A1, A2, pyruvate, ammonia or serine may also be used in the process. Here, serine may be D-serine or L-serine.

In some embodiments of the reaction, the reaction conditions may include a suitable pH. As described above, the desired pH or desired pH range can be maintained by using an acid or base, a suitable buffer, or a combination of buffer and added acid or base. The pH of the reaction mixture can be controlled before and/or during the reaction. In some embodiments, suitable reaction conditions include a solution pH of about 4 to about 11. In some embodiments, the reaction conditions include a solution pH of about 4.0, 4.5, 5.0, 5.5, 6.0, 6.5, 7, 7.5, 8, 8.5, 9, 9.5, 10, 10.5, 11.0.

In embodiments of the processes herein, suitable temperatures can be used for the reaction conditions, taking into consideration of, for example, the increase in reaction rate at higher temperatures, the activity of the enzyme for sufficient duration of the reaction. Accordingly, in some embodiments, suitable reaction conditions include a temperature of about 10° C. to about 60° C., about 25° C. to about 50° C., about 25° C. to about 40° C., or about 25° C. to about 30° C. In some embodiments, suitable reaction temperatures include a temperature of about 10° C., 15° C., 20° C., 25° C., 30° C., 35° C., 40° C., 45° C., 50° C., 55° C., or 60° C. In some embodiments, the temperature during the enzymatic reaction can be maintained at a certain temperature throughout the reaction. In some embodiments, the temperature during the enzymatic reaction may be adjusted over a temperature profile during the course of the reaction.

The processes of using engineered polypeptides are generally carried out in aqueous environment or in a solvent. Suitable solvents include aqueous buffer solutions, organic solvents, and/or co-solvent systems, which generally include aqueous solvents and organic solvents. The aqueous solutions (water or aqueous co-solvent systems) can be pH-buffered or unbuffered. In some embodiments, the processes of using engineered polypeptides are generally carried out in an aqueous co-solvent system comprising an organic solvent (e.g., methanol, ethanol, propanol, isopropanol (IPA), dimethyl sulfoxide (DMSO), dimethylformamide (DMF), isopropyl acetate, ethyl acetate, butyl acetate, 1-octanol, heptane, octane, methyl tert-butyl ether (MTBE), Toluene, etc.), ionic liquids (for example, 1-ethyl 4-methylimidazolium tetrafluoroborate, 1-butyl-3-methylimidazolium tetrafluoroborate, 1-butyl-3-methylimidazolium hexafluorophosphate, and the like). The organic solvent component of the aqueous co-solvent system may be miscible with the aqueous component, providing a single liquid phase, or may be partially miscible or immiscible with the aqueous component, providing two liquid phases. Exemplary aqueous co-solvent system comprises water and one or more organic solvents. In general, the organic solvent component of the aqueous co-solvent system is selected such that it does not completely inactivate the engineered polypeptide. Suitable co-solvent system can be readily identified by measuring the enzymatic activity of a particularly engineered polypeptide with a defined substrate of interest in the candidate solvent system, utilizing enzymatic activity assays, such as those described herein. In some embodiments of the process, suitable reaction conditions include an aqueous co-solvent comprising a solvent at a concentration of about 1% to about 95% (v/v), about 1% to about 60% (v/v), about 2% to about 60% (v/v), about 5% to about 60% (v/v), about 10% to about 60% (v/v), about 10% to about 50% (v/v), or about 10% to about 40% (v/v). In some embodiments of the process, suitable reaction conditions include an aqueous co-solvent comprising a solvent at a concentration of at least about 1%, 5%, 10%, 15%, 20%, 25%, 30%, 35%, 40%, 45%, 50%, 55%, 60%, 65%, 70%, 75%, 80%, 85%, 90% or 95% (v/v).

Suitable reaction conditions may include a combination of reaction parameters that allows the biocatalytic conversion of the substrate compounds to its corresponding product compound. Accordingly, in some embodiments of the process, the combination of reaction parameters comprises: (a) a loading of about 5 g/L to 250 g/L of compound (II), A1, or A2; (b) engineered polypeptide concentration of about 1 g/L to 50 g; (c) pH of about 4.0 to 11.0; and (d) temperature of about 10° C. to 60° C.

In some embodiments, the engineered polypeptides capable of performing the above reactions comprise an amino acid sequence selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308.

Exemplary reaction conditions include the conditions provided in Table 2, Table 3, and Examples 8-12.

In carrying out the enzyme-catalyzed reaction described herein, the engineered polypeptide may be added to the reaction mixture in the partially purified or purified forms, a heat-treated enzyme solution, whole cells transformed with gene encoding the engineered polypeptides, and/or as cell extracts and/or lysates of such cells. Whole cells transformed with the gene encoding the engineered polypeptide or cell extract thereof, lysates thereof, and isolated enzymes can be used in a wide variety of different forms, including solids (e.g., lyophilized, spray-dried, or the like) or semi-solid (e.g., a crude paste such as wet cells). The cell extract or cell lysate may be partially purified by precipitation (e.g., ammonium sulfate, polyethyleneimine, heat treatment, or the like), followed by desalting procedure (e.g., ultrafiltration, dialysis, and the like) prior to lyophilization. Any of the enzyme preparations can be stabilized by crosslinking using known crosslinking agents, such as glutaraldehyde, or immobilization to a solid phase material (such as a resin).

In some embodiments of the enzyme-catalyzed reactions described herein, the reaction is performed under suitable reaction conditions described herein, wherein the engineered polypeptide is immobilized to a solid support. Solid supports useful for immobilizing the engineered polypeptides for carrying out the enzyme-catalyzed reactions include but are not limited to beads or resins such as polymethacrylates with epoxy functional groups, polymethacrylates with amino epoxy functional groups, styrene/DVB copolymer with octadecyl functional group, or polymethacrylates with octadecyl functional group. Exemplary solid supports include, but are not limited to, chitosan beads, Eupergit C, and SEPABEAD (Mitsubishi), including the following different types of SEPABEAD: EC-EP, EC-HFA/S, EXA252, EXE119, and EXE120.

In some embodiments, wherein an engineered polypeptide is expressed in the form of a secreted polypeptide, a culture medium containing the secreted polypeptide can be used in the process herein.

In some embodiments, the solid reactants (e.g., enzymes, salts, etc.) can be provided to the reaction in a variety of different forms, including powders (e.g., lyophilized, spray dried, etc.), solutions, emulsions, suspensions, and the like. The reactants can be readily lyophilized or spray-dried using methods and instrumentation known to one skilled in the art. For example, the protein solution can be frozen at −80° C. in small aliquots, and then added to the pre-chilled lyophilization chamber, followed by the application of a vacuum.

In some embodiments, there are multiple options of the order or the manner by which the reactants are added into reaction vessels. The reactants may be added together to the solvent at the same time (e.g., monophasic solvent, a biphasic aqueous co-solvent system, etc.); or alternatively, some reactants can be added first, and other reactants can be continuously dosed into the reaction vessel, or added in separate batches.

Different features and embodiments of the present disclosure are exemplified in the following representative examples, which are intended to be illustrative and not restrictive.

EXAMPLES

The following examples further illustrate the present invention, but the present invention is not limited thereto. In the following examples, experimental methods with conditions not specified, were conducted at the commonly used conditions or according to the suppliers' suggestion.

Example 1: Gene Cloning and Construction of Expression Vectors

The amino acid sequence of the wild-type tyrosine phenol-lyase from Citrobacterfreundii can be retrieved from NCBI, and the corresponding nucleic acids were then synthesized using conventional techniques in the art and cloned into the expression vector pACYC-Duet-1. The recombinant expression plasmid was transformed into E. coli BL21

(DE3) competent cells under the conditions of 42° C. and thermal shock for 90 seconds. The transformation solution was plated on LB agar plates containing chloramphenicol which was then incubated overnight at 37° C. Recombinant transformants were obtained.

Example 2: Construction of Engineered Polypeptide Mutant Library

All reagents used here are commercially available, and Quickchange kit (supplier: Agilent) preferably used. The sequence design of the mutagenesis primers was performed according to the instructions of the kit. The construction of a site-saturation mutagenesis library is now illustrated as an example. The PCR reaction consisted of 10 μl of 5× Buffer, 1 μl of 10 mM dNTP, 1 μl of plasmid DNA template (50 ng/μl), 0.75 μl (10 uM) each of the upstream and downstream primers, 0.5 μl of high fidelity enzyme and 36 μl of ddH2O. The PCR primer has a NNK codon at the mutation position.

The PCR amplification steps are: (1) 98° C. pre-denaturation 3 min; (2) 98° C. denaturation 10 s; (3) annealing and extension 3 min at 72° C.; steps of (2)~(3) repeated 25 times; (4) extension 10 min at 72° C. followed by cooling to 4° C. 2 μl of DpnI was added to the PCR product and the plasmid template was eliminated by overnight digestion at 37° C. The digested PCR product was transformed into *E. coli* BL21 (DE3) competent cells and plated on LB agar plates containing chloramphenicol to obtain a site-saturation mutagenesis library for the target residue position.

Example 3: Expression of Enzyme Mutant Libraries and Preparation of Enzyme Solution for Screening Colonies of enzyme mutant library were picked from agar plates and inoculated into LB medium containing chloramphenicol in 96-well shallow plates (200 μl LB medium per well), placed in a shaker at 180 rpm, 80% humidity, and 30° C. over night (18 to 20 hours). When the $OD_{600}$ of the culture reached 2-3, 20 μl of the culture were used to inoculate a deep 96-well plate (each well containing 400 μL of TB medium and 6 g/L lactose) which was then placed in a shaker at 250 rpm, 30° C. and 80% humidity for overnight culture (18 to 20 hours). Thereafter, the deep-well plate culture was centrifuged at 4000 rpm for 10 min, and the culture medium was removed to obtain wet cells. Next, wet cells were suspended with 200 μL/well of lysis buffer (100 mM TEOA, pH 8.5, containing 1 mg/mL lysozyme, 0.5 g/L nuclease, 0.2 mM PLP), and then the plates were shaken at 700 rpm for 1 hour to lyse the cells. The cell lysate was centrifuged at 4000 rpm for 10 minutes, and 160 μL of the supernatant was transferred into a fresh plate to obtain enzyme solution for the screening reaction.

Example 4: Screening Assay

The enzyme solution prepared as in Example 3 can be directly used in the screening reaction. For each well in a 96-well plate, 40 μL of enzyme solution were mixed with 160 μL of a stock solution, the final concentration of each component in the reaction system was [phenol 20 g/L, sodium pyruvate 25 g/L, ammonium acetate 18 g/L, 0.2 mM PLP, 0.1M TEOA, pH 8.5]. The reaction plate was shaken at 250 rpm and 40° C. for 24 hours in a shaker. After the reaction was stopped, 40 μL of 2M NaOH solution were added to each well to quench the reaction, shaken for 30 min (800 rpm) in a plate shaker, then centrifuged at 4000 rpm for 30 min. After centrifugation, the supernatant was collected for HPLC analysis. HPLC analysis was performed according to the method of Example 6, and the conversion of phenol to L-tyrosine was calculated.

Example 5: Pretreatment of Enzyme Solution by Phenol and Screening Assay

40 μL of the enzyme solution prepared as in Example 3 and 160 μL of pretreatment stock solution containing phenol were mixed in a 96-well plate. The plate was placed in a shaker at 250 rpm, 40° C. for 20 hours to obtain the pretreated enzyme solution. The concentration of phenol in the pretreatment stock solution can be adjusted according to assay requirements. For example, if the final concentration of phenol in pretreatment is 11 g/L (corresponding to the case of [11 g/L phenol, 20 h] in Table 3), the pretreatment stock solution was prepared as follows: 13.75 g/L phenol, 0.1 M TEOA, 0.2 mM PLP, pH 8.5. After the pretreatment was done, 200 μL of the pretreated enzyme solution were mixed with 100 μL of the reaction stock solution containing phenol, sodium pyruvate, and ammonium acetate in a 96-well plate (the preparation of the stock solution makes the final concentration of each reaction component to satisfy each reaction condition in Table 3), placed in a shaker at 250 rpm and 40° C. for 6 hours.

After the reaction was completed, 60 μL of 2M NaOH solution were added to each well to quench the reaction, placed in a shaker for 30 min (800 rpm), then centrifuged (4000 rpm, 30 min). After centrifugation, the supernatant was collected for HPLC analysis. HPLC analysis was performed according to the method of Example 6, and the conversion of phenol to L-tyrosine was calculated.

Example 6: Analytical Method

HPLC analytical method of phenol and L-tyrosine: Analytical column was Luna 5 μm $NH_2$ 150*4.5 mm, mobile phase was 0.1% acetic acid aqueous solution:acetonitrile=50:50, flow rate was 2 mL/min, detection wavelength was 275 nm, the retention time of phenol was 1.0 min, and the retention time of L-tyrosine was 1.4 min.

HPLC analytical method of D-tyrosine and L-tyrosine: Analytical column was Chirex 3126 150*4.5 mm, mobile phase was 3 mM copper sulfate, flow rate was 1.2 mL/min, detection wavelength was 226 nm, the retention time of L-tyrosine was 31 min and the retention time of D-tyrosine was 55 min.

Example 7: Fermentation Process for the Expression of Engineered Polypeptide

A single colony of *E. coli* BL21 (DE3) containing an expression plasmid bearing the gene of target engineered polypeptide was inoculated into 50 mL of LB broth (5.0 g/L Yeast Extract, 10 g/L Tryptone, 10 g/L Sodium chloride) containing 30 μg/mL chloramphenicol. It was shaken at 250 rpm in a 30° C. shaker for at least 16 hours. When the $OD_{600}$ of the culture reached 1.4 to 2.0, the cells are taken from the incubator, and used immediately or stored at 4° C.

A 5 L fermenter containing 2.0 L of growth medium was sterilized in an autoclave at 121° C. for 30 minutes. The fermenter was inoculated with the abovementioned (grown in shake flasks as described above to an initial $OD_{600}$ of 1.4 to 2.0). Temperature of fermenter was maintained at 30° C. by jacketed circulating water. The growth medium in fermenter was agitated at 200-800 rpm, and air was supplied at 2-8 L/min to maintain the dissolved oxygen level at 40% of saturation or greater. The pH of culture medium maintained at pH 7.0 by addition of 25-28% v/v ammonium hydroxide. Cell growth was maintained by feeding a feed solution containing 500 g/L of dextrose glucose monohydrate, 12 g/L ammonium chloride, and 5 g/L magnesium sulfate heptahydrate. After the $OD_{600}$ of culture reached 25±5, the temperature of fermenter was maintained at 30° C., and the expression of the engineered TPL polypeptide was induced by the addition of lactose to a final concentration of 3.8 g/L. The fermentation process then continued for additional 18 hours. After the fermentation was completed, cells were harvested using a Thermo MuLtifuge X3R centrifuge at 8000 rpm for 10 minutes at 4° C.

The wet cells were resuspended with 10 mM potassium phosphate buffer, pH 7.0 at 4° C. Cells were harvested again using a Thermo MuLtifuge X3R centrifuge at 8000 rpm for 10 minutes at 4° C. to obtain washed wet cells. 10 g of the such washed wet cells were resuspended in 50 mL of 10 mM potassium phosphate buffer at pH 7.0, and it was disrupted twice with a pressure homogenizer to obtain a homogenized lysate. The lysate was centrifuged at 4000 rpm for 30 min, and the supernatant was collected to obtain enzyme solution containing engineered TPL polypeptides.

Example 8: Reaction Process of Producing L-Tyrosine Catalyzed by Engineered Polypeptides Through Substrate Dosing The following is a representative reaction process and workup process at 300 mL reaction volume. In a 500 mL reaction vessel, 13.11 g of ammonium acetate and 169 mL of water were added, and the temperature was controlled at 40° C. in a water bath and the stirring speed was 400 rpm. Then 1 g of phenol aqueous solution (concentration 92%, m/m) and 6.2 mL of sodium pyruvate aqueous solution (234.4 g/L) were added and pH was adjusted to 8.5 with ammonia, followed by addition of 3 mL of PLP aqueous solution (20 mM). Finally, 7.5 mL of enzyme solution corresponding to SEQ ID No: 174 were added to start the reaction. During the reaction, a total of 16.42 g of phenol aqueous solution (concentration 92%, m/m) and 93.8 mL of sodium pyruvate solution (234.4 g/L) were dosed into the reaction vessel at a constant rate over 15 hours. After 24 hours of the reaction, the reaction was sampled for analysis. The conversion of phenol to L-tyrosine was ≥95%, and the ee value of L-tyrosine in the product was ≥99.5%.

The reaction was stopped, reaction mixture was filtered, and the filter cake was rinsed three times with 50 mL of pure water. Then the filter cake was removed, dispersed, and dried in an oven at 60° C. for 12 hours. The dried solid was weighed to obtain 26.2 g of isolated L-tyrosine. The yield was about 85%.

Example 9: Reaction Process of Producing L-Tyrosine Catalyzed by Engineered Polypeptides Through Batchwise Addition of Substrate In a 250 mL reaction vessel, 4.37 g of ammonium acetate and 71 mL of water were added, and the temperature was controlled at 40° C. in a water bath and the stirring speed was 400 rpm. 0.55 mL of phenol aqueous solution (concentration 92%, m/m) and 0.78 g of sodium pyruvate (solid) were then added and pH was adjusted to 8.5 with ammonia, followed by addition of 2 mL of PLP aqueous solution (20 mM). Finally, 5 mL of enzyme solution corresponding to SEQ ID No: 304 was added to start the reaction. From the beginning of the reaction, 0.55 mL of a phenol aqueous solution (concentration 92%, m/m) and 0.78 g of sodium pyruvate (solid) were added once in every hour for a total of 19 hours. Meanwhile, 5 mL of enzyme solution corresponding to SEQ ID No: 304 were added at the $6^{th}$ hour and $12^{th}$ hour, respectively; 11 mL of ammonium acetate aqueous solution (400 g/L, pH 8.5 adjusted with 2M NaOH) were added at the $8^{th}$ hour. After 24 hours of the reaction, the reaction was sampled for analysis. The concentration of L-tyrosine in the reaction system was about 200 g/L. The conversion of phenol to L-tyrosine was ≥95%. The ee value of L-tyrosine in the product was 99.5%.

The reaction was stopped, reaction mixture was filtered, and the filter cake was rinsed three times with 50 mL of pure water. Then the filter cake was removed, dispersed, and dried in an oven at 60° C. for 12 hours. The dried solid was weighed to obtain 19.5 g of isolated L-tyrosine. The yield was about 95%.

Example 10: Reaction Process for the Production of L-DOPA Catalyzed by Engineered Polypeptides The following is a representative reaction process at 300 mL volume. In a 500 mL reaction vessel, 14.61 g of ammonium acetate and 113 mL of water were added, the temperature was controlled at 15° C. in the water bath and the stirring speed was 400 rpm. The following substances were then added to the reaction vessel: 1.88 mL of catechol solution (400 g/L), 5.12 mL of sodium pyruvate solution (234.4 g/L), 0.3 g of sodium sulfite, 0.6 g of EDTA·2Na, pH was adjusted to 8.0 with ammonia, followed by addition of 3 mL of PLP solution (20 mM). Finally, 30 mL of enzyme solution corresponding to SEQ ID No: 128 were added to start the reaction, and the air in the reaction vessel was immediately replaced with nitrogen. During the reaction, 50.62 mL of a catechol solution (400 g/L) and 94.88 mL of a sodium pyruvate solution (234.4 g/L) were dosed into the reaction vessel at a constant rate over 24.5 hours. After 30 hours of reaction, it was sampled for analysis. The conversion of catechol to L-DOPA was ≥95%, and the ee value of L-DOPA in the product was ≥99.5%.

The reaction was stopped, the reaction mixture was filtered, and the filter cake was rinsed three times with 50 mL of pure water. Then the filter cake was removed, dispersed, and dried in vacuum (40° C., 0.1 MPa) for 12 hours. The dried solid was weighed to obtain 28.5 g of isolated L-DOPA. The yield was about 85%.

Example 11: Reaction Process of Producing L-Tyrosine from Phenol and D-Serine or L-Serine Catalyzed by Engineered Polypeptides The following is a representative 5 mL reaction process. In a 30 mL reaction vessel, the following substances were added: 26.7 mg of phenol, 60 mg of D-serine or L-serine, 4.4 mL of TEOA-HCl (0.1M, pH 8.5), pH was adjusted to 8.5 with ammonia, followed by addition of 0.1 mL of PLP solution (10 mM). Finally, 0.5 mL of the enzyme solution corresponding to SEQ ID No: 278 were added, and the reaction was started on a magnetic stirring reactor at 400 rpm, 40° C. After 24 hours of reaction, it was sampled for analysis. The conversion of phenol to L-tyrosine was ≥95%, and the ee value of L-tyrosine in the product was ≥99.5%.

Example 12: Reaction Process of Producing L-DOPA from Catechol and D-Serine or L-Serine Catalyzed by Engineered Polypeptides The following is a representative 5 mL reaction process. In a 30 mL reaction vessel, the following substances were added: 25 mg of catechol, 60 mg of D-serine or L-serine, 5 mg of sodium sulfite, and 10 mg of EDTA·2Na, 4.4 mL TEOA-HCl (0.1M, pH8.0), pH was adjusted to 8.0 with ammonia water, followed by addition of 0.1 mL of 10 mM PLP. Finally, 0.5 mL of enzyme solution corresponding to SEQ ID No: 280 were added. The reaction was started on a magnetic stirring reactor at 400 rpm and 15° C. After 24 hours of reaction, it was sampled for analysis. The conversion of catechol to L-DOPA was ≥95%, and the ee value of L-DOPA in the product was ≥99.5%.

It should be understood that after reading the above contents of the present invention, those skilled in the art may make various modifications or changes to the present invention. And these equivalent forms also fall within the scope of the appended claims of the present invention.

SEQUENCE LISTING (308 sequences)

SEQ ID NO: 1 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgagcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 2 - protein, 456 aa, Citrobacter freundii
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 3 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgaacatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgactacatc

SEQ ID NO: 4 - protein, 456 aa, Artificial sequence
  Engineered sequence
MNYPAEPFRIKSVETVSMIPRDERLKAMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 5 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgaacatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 6 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 7 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgaacatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgagtacatc

SEQ ID NO: 8 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 9 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgactacatc

SEQ ID NO: 10 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 11 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttctggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgactacatc

SEQ ID NO: 12 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVLGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 13 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttctggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgagtacatc

SEQ ID NO: 14 - protein, 456 aa, Artificial sequence
  Engineered sequence
MNYPAEPFRIKSVETVSMIPRDERLKKMQEAGYNTFLLNSKDTYIDLLTDSGTNAMSDKQWAGMMMGDEAYAGSENFYHLERTVQELFGFKHIVPTHQGRGAENLLSQLAIKPGQYVLGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 15 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgagtacatc

SEQ ID NO: 16 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 17 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 18 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 19 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaactgaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgccctcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgactacatc

SEQ ID NO: 20 - protein, 456 aa, Artificial sequence
  Engineered sequence
MNYPAEPFRIKSVETVSMIPRDERLKKMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQELNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 21 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 22 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 23 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgactacatc

SEQ ID NO: 24 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 25 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 26 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 27 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttctggggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 28 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVLGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 29 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggcctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgagcatctgacgcaagatgagttcccggcacaaagtctggctgccagcatctatgtggaaaccggcgtgcgtagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 30 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVAYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 31 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgagagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgagcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 32 - protein, 456 aa, Artificial sequence
  Engineered sequence
MNYPAEPFRIKSVETVSMIPRDERLKKMQEAGYNTFLLNSRDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 33 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgagcatctgacgcaagatgagttcccggcacaaagtctggctgccagcatctatgtggaaaccggcgtgcgcagtatggagcgcggaattgtctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 34 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIVSAGRNNVTGEHHRPKLETVRLTIPRRVYTYAHMDVVADGIIKLYQHKEDIRGLKFIYEPKQLRFFTARFDYI

SEQ ID NO: 35 - DNA, 1368 bp, Artificial sequence
  Engineered sequence
atgaattatccggcagaacccttccgtactaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgagcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 36 - protein, 456 aa, Artificial sequence
  Engineered sequence
MNYPAEPFRTKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 37 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctcgcttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgagcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 38 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYISLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 39 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtgcggcggtattcctcgatgcgcgtcgcttctgcgagcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 40 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGAAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 41 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgagcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtcattttactgcacgctttgattacatc

SEQ ID NO: 42 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRHFTARFDYI

SEQ ID NO: 43 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgagcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttcatgactgcacgctttgattacatc

SEQ ID NO: 44 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFMTARFDYI

SEQ ID NO: 45 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcgtgcggtattcctcgatgcgcgtcgcttctgcgagcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 46 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGRAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 47 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgagcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttcgttactgcacgctttgattacatc

SEQ ID NO: 48 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFVTARFDYI

SEQ ID NO: 49 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgcgaagctgaaagccgctggcgtaccgattgttgaaccggtaggcggtcacgcggtattcctcgatgcgcgtcgcttctgcgagcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 50 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGAKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 51 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgagaagctgaaagccgctggcgtaccgattgttgaaccggtaggcggtcacgcggtattcctcgatgcgcgtcgcttctgcgagcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatc

SEQ ID NO: 52 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGEKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 53 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtttgcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 54 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRLHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 55 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtattcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 56 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRIHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 57 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtgttcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 58 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRVHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 59 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttggcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 60 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRWHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 61 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 62 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 63 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgatttttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 64 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAIFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 65 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacaatgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 66 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNNAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 67 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 68 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 69 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgttggatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 70 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEALDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 71 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatcttgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 72 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDLVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 73 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcggaggatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 74 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAEDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 75 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggggtccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 76 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGGPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 77 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggttgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 78 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGLPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 79 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggctccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 80 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 81 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtggggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 82 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSGERGIISAGRNNVTGEHHRPKLETVRLTIPRRVYTYAHMDVVADGIIKLYQHKEDIRGLKFIYEPKQLRFFTARFEYI

SEQ ID NO: 83 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggtttccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 84 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGFPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 85 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggcatccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 86 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGHPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 87 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagaatcgtttctttactgcacgctttgaatacatc

SEQ ID NO: 88 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQNRFFTARFEYI

SEQ ID NO: 89 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtggctgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 90 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVAVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 91 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtaagtttactgcacgctttgaatacatc

SEQ ID NO: 92 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRKFTARFEYI

SEQ ID NO: 93 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtatgtttactgcacgctttgaatacatc

SEQ ID NO: 94 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRMFTARFEYI

SEQ ID NO: 95 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacacccgagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 96 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHPRPKLETVRLTIPRRVYTYAHMDVVADGIIKLYQHKEDIRGLKFIYEPKQLRFFTARFEYI

SEQ ID NO: 97 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtcatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 98 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRHHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 99 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtatccaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 100 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRIHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 101 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 102 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 103 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 104 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 105 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 106 - protein, 456 aa, Artificial sequence
  Engineered sequence
MNYPAEPFRIKSVETVSMIPRDERLKAMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 107 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 108 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 109 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 110 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 111 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttggcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 112 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRWHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 113 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtatccaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacaacgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 114 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRIHQERNGATFVDVVRDEAHDAGLNIAFKGDIDLKKLQKLIDEKGAENIAYICLAVTVNNAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 115 - DNA, 1368 bp, Artificial sequence
  Engineered sequence
atgaattatccggcagaacccttccgtattaaaagcgttgaaactgtatctatgatcccgcgtgatgaacgcctcaaggaaatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgatgtttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 116 - protein, 456 aa, Artificial sequence
  Engineered sequence
MNYPAEPFRIKSVETVSMIPRDERLKEMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGAMFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 117 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 118 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 119 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 120 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 121 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 122 - protein, 456 aa, Artificial sequence
  Engineered sequence
MNYPAEPFRIKSVETVSMIPRDERLKKMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 123 - DNA, 1368 bp, Artificial sequence
  Engineered sequence
atgaattatccggcagaacccttccgtattaaaagcgttgaaactgtatctatgatcccgcgtgatgaacgcctcaaggagatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacatcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 124 - protein, 456 aa, Artificial sequence
  Engineered sequence
MNYPAEPFRIKSVETVSMIPRDERLKEMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNIAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 125 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttggcaccaggaacggaatggtgcgacctttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 126 - protein, 456 aa, Artificial sequence
  Engineered sequence
MNYPAEPFRIKSVETVSMIPRDERLKAMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRWHQERNGATFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 127 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 128 - protein, 456 aa, Artificial sequence
  Engineered sequence
MNYPAEPFRIKSVETVSMIPRDERLKAMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 129 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtatccaccaggaacggaatggtgcggtgtttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 130 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRIHQERNGAVFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 131 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 132 - protein, 456 aa, Artificial sequence
  Engineered sequence
MNYPAEPFRIKSVETVSMIPRDERLKKMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 133 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 134 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 135 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 136 - protein, 456 aa, Artificial sequence
  Engineered sequence
MNYPAEPFRIKSVETVSMIPRDERLKAMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 137 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctacactgcacgctttgaatacatc

SEQ ID NO: 138 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFYTARFEYI

SEQ ID NO: 139 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaattcgaaagatatctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggagcccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 140 - protein, 456 aa, Artificial sequence
  Engineered sequence
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQERNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGSPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 141 - DNA, 1368 bp, Artificial sequence
  Engineered sequence
atgaattgtccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacccgggcacatatggatgttgtggctgacggtattattaaactttaccagcacaaagaagatattcgcgggctgaagtttatttacgagccgaagcagttgcgtttctttactgcacgctttgaatacatc

SEQ ID NO: 142 - protein, 456 aa, Artificial sequence
  Engineered sequence
MNCPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTRAHMDVVADGIIKLYQHKEDIRGLKFIYEPKQLRFFTARFEYI

SEQ ID NO: 143 - DNA, 1368 bp, Artificial sequence
  Engineered sequence
atgaattttccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 144 - protein, 456 aa, Artificial sequence
  Engineered sequence
MNFPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 145 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtttgcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 146 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRLHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 147 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtaggcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 148 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRRHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 149 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacttaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 150 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQELNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 151 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaaaataatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 152 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQENNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 153 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgaccaccagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 154 - protein, 456 aa, Artificial sequence
  Engineered sequence
MNYPAEPFRIKSVETVSMIPRDERLKAMQEAGYNTFLLNSKDTYIDLLTDSGTNAMSDHQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 155 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatgaacgttgtggctgacggtattattaaactttaccagcacaaagaagatattcgcgggctgaagtttatttacgagccgaagcagttgcgtttctttactgcacgctttgaatacatc

SEQ ID NO: 156 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMNVVADGIIKLYQHKEDIRGLKFIYEPKQLRFFTARFEYI

SEQ ID NO: 157 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggttcccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 158 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGFPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 159 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggctgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 160 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGLPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 161 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgttgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 162 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMLGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 163 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttaagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 164 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFKNKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 165 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttcataacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 166 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFHNKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 167 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttcagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 168 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFQNKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 169 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttacgatcacaaagaagatattcgcgggctgaagtttatttacgagccgaagcagttgcgtttctttactgcacgctttgaatacatc

SEQ ID NO: 170 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYDHKEDIRGLKFIYEPKQLRFFTARFEYI

SEQ ID NO: 171 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttggaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 172 - protein, 456 aa, Artificial sequence
  Engineered sequence
MNYPAEPFRIKSVETVSMIPRDERLKAMQEAGWNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 173 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 174 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 175 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttatattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 176 - protein, 456 aa, Artificial sequence
  Engineered sequence
MNYPAEPFRIKSVETVSMIPRDERLKAMQEAGYNTFLLYSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 177 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttacgttcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 178 - protein, 456 aa, Artificial sequence
  Engineered sequence
MNYPAEPFRIKSVETVSMIPRDERLKAMQEAGYNTFLLRSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 179 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaaggggttgcgtttctttactgcacgctttgaatacatc

SEQ ID NO: 180 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKGLRFFTARFEYI

SEQ ID NO: 181 - DNA, 1368 bp, Artificial sequence
  Engineered sequence
atgaattatccggcagaacccttccgtattaaaagcgttgaaactgtatctatgatcccgcgtgatgaacgcctcaagcggatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 182 - protein, 456 aa, Artificial sequence
  Engineered sequence
MNYPAEPFRIKSVETVSMIPRDERLKRMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 183 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgtattacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 184 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVYYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 185 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtacccatagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 186 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTHSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 187 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaattcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtcctaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 188 - protein, 456 aa, Artificial sequence
  Engineered sequence
MNYPAEPFRIKSVETVSMIPRDERLKAMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSPKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 189 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtcgccaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttttacgacgctacccgctgcgtagaaaacgcctactttatcaaagagcaagagcagggctttcaaaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 190 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRRHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFQNKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 191 - DNA, 1368 bp, Artificial sequence
  Engineered sequence
atgaattatccggcagaacccttccgtattaaaagcgttgaaactgtatctatgatcccgcgtgatgaacgcctcaagcgcatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtcgccaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttttacgacgctacccgctgcgtagaaaacgcctactttatcaaagagcaagagcagggctttgaaaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 192 - protein, 456 aa, Artificial sequence
  Engineered sequence
MNYPAEPFRIKSVETVSMIPRDERLKRMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRRHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 193 - DNA, 1368 bp, Artificial sequence
  Engineered sequence
atgaattatccggcagaacccttccgtattaaaagcgttgaaactgtatctatgatcccgcgtgatgaacgcctcaagcgcatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgtattacgacgctacccgctgcgtagaaaacgcctactttatcaaagagcaagagcagggctttcagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagggcttgcgtttctttactgcacgctttgaatacatc

SEQ ID NO: 194 - protein, 456 aa, Artificial sequence
  Engineered sequence
MNYPAEPFRIKSVETVSMIPRDERLKRMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVYYDATRCVENAYFIKEQEQGFQNKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKGLRFFTARFEYI

SEQ ID NO: 195 - DNA, 1368 bp, Artificial sequence
  Engineered sequence
atgaattatccggcagaacccttccgtattaaaagcgttgaaactgtatctatgatcccgcgtgatgaacgcctcaagaacatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgtattacgacgctacccgctgcgtagaaaacgcctactttatcaaagagcaagagcagggctttgaaaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 196 - protein, 456 aa, Artificial sequence
  Engineered sequence
MNYPAEPFRIKSVETVSMIPRDERLKNMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVYYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 197 - DNA, 1368 bp, Artificial sequence
  Engineered sequence
atgaattatccggcagaacccttccgtattaaaagcgttgaaactgtatctatgatcccgcgtgatgaacgcctcaagaacatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtcgccaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgtattacgacgctacccgctgcgtagaaaacgcctactttatcaaagagcaagagcagggctttgaaaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 198 - protein, 456 aa, Artificial sequence
  Engineered sequence
MNYPAEPFRIKSVETVSMIPRDERLKNMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRRHQERNGATFVDVVRDEAHDAGLNIAFKGDIDLKKLQKLIDEKGAENIAYICLAVTVNLAGGQPVSMANMRAVRELTEAHGIKVYYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 199 - DNA, 1368 bp, Artificial sequence
  Engineered sequence
atgaattatccggcagaacccttccgtattaaaagcgttgaaactgtatctatgatcccgcgtgatgaacgcctcaagaacatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgtcgccaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttttacgacgctacccgctgcgtagaaaacgcctactttatcaaagagcaagagcagggctttcaaaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 200 - protein, 456 aa, Artificial sequence
  Engineered sequence
MNYPAEPFRIKSVETVSMIPRDERLKNMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRRHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFQNKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 201 - DNA, 1368 bp, Artificial sequence
  Engineered sequence
atgaattatccggcagaacccttccgtattaaaagcgttgaaactgtatctatgatcccgcgtgatgaacgcctcaagaacatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttttacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 202 - protein, 456 aa, Artificial sequence
  Engineered sequence
MNYPAEPFRIKSVETVSMIPRDERLKNMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 203 - DNA, 1368 bp, Artificial sequence
  Engineered sequence
atgaattatccggcagaacccttccgtattaaaagcgttgaaactgtatctatgatcccgcgtgatgaacgcctcaagcgcatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttttacgacgctacccgctgcgtagaaaacgcctactttatcaaagagcaagagcagggctttgaaaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 204 - protein, 456 aa, Artificial sequence
  Engineered sequence
MNYPAEPFRIKSVETVSMIPRDERLKRMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 205 - DNA, 1368 bp, Artificial sequence
  Engineered sequence
atgaattatccggcagaacccttccgtattaaaagcgttgaaactgtatctatgatcccgcgtgatgaacgcctcaagaacatgcaggaagcgggttacaatactttcctgttacgctcgagcgatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 206 - protein, 456 aa, Artificial sequence
  Engineered sequence
MNYPAEPFRIKSVETVSMIPRDERLKNMQEAGYNTFLLRSSDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 207 - DNA, 1368 bp, Artificial sequence
  Engineered sequence
atgaattatccggcagaacccttccgtattaaaagcgttgaaactgtatctatgatcccgcgtgatgaacgcctcaagacgatgcaggaagcgggttacaatactttcctgttaaaatcgacggatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 208 - protein, 456 aa, Artificial sequence
  Engineered sequence
MNYPAEPFRIKSVETVSMIPRDERLKTMQEAGYNTFLLKSTDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 209 - DNA, 1368 bp, Artificial sequence
  Engineered sequence
atgaattatccggcagaacccttccgtattaaaagcgttgaaactgtatctatgatcccgcgtgatgaacgcctcaagaacatgcaggaagcgggttacaatactttcctgttacgctcgcgcgatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 210 - protein, 456 aa, Artificial sequence
  Engineered sequence
MNYPAEPFRIKSVETVSMIPRDERLKNMQEAGYNTFLLRSRDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 211 - DNA, 1368 bp, Artificial sequence
  Engineered sequence
atgaattatccggcagaacccttccgtattaaaagcgttgaaactgtatctatgatcccgcgtgatgaacgcctcaagcagatgcaggaagcgggttacaatactttcctgttaaactcgcaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 212 - protein, 456 aa, Artificial sequence
  Engineered sequence
MNYPAEPFRIKSVETVSMIPRDERLKQMQEAGYNTFLLNSQDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 213 - DNA, 1368 bp, Artificial sequence
  Engineered sequence
atgaattatccggcagaacccttccgtattaaaagcgttgaaactgtatctatgatcccgcgtgatgaacgcctcaagcgtatgcaggaagcgggttacaatactttcctgttacactcgacggatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 214 - protein, 456 aa, Artificial sequence
  Engineered sequence
MNYPAEPFRIKSVETVSMIPRDERLKRMQEAGYNTFLLHSTDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 215 - DNA, 1368 bp, Artificial sequence
  Engineered sequence
atgaattatccggcagaacccttccgtattaaaagcgttgaaactgtatctatgatcccgcgtgatgaacgcctcaagcacatgcaggaagcgggttacaatactttcctgttacgctcgacggatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 216 - protein, 456 aa, Artificial sequence
  Engineered sequence
MNYPAEPFRIKSVETVSMIPRDERLKHMQEAGYNTFLLRSTDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 217 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 218 - protein, 456 aa, Artificial sequence
  Engineered sequence
MNYPAEPFRIKSVETVSMIPRDERLKKMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 219 - DNA, 1368 bp, Artificial sequence
  Engineered sequence
atgaattatccggcagaacccttccgtattaaaagcgttgaaactgtatctatgatcccgcgtgatgaacgcctcaagcgcatgcaggaagcgggttacaatactttcctgttaaaatcgcaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 220 - protein, 456 aa, Artificial sequence
  Engineered sequence
MNYPAEPFRIKSVETVSMIPRDERLKRMQEAGYNTFLLKSQDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 221 - DNA, 1368 bp, Artificial sequence
  Engineered sequence
atgaattatccggcagaacccttccgtattaaaagcgttgaaactgtatctatgatcccgcgtgatgaacgcctcaagaacatgcaggaagcgggttacaatactttcctgttacgctcgaacgatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 222 - protein, 456 aa, Artificial sequence
  Engineered sequence
MNYPAEPFRIKSVETVSMIPRDERLKNMQEAGYNTFLLRSNDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 223 - DNA, 1368 bp, Artificial sequence
  Engineered sequence
atgaattatccggcagaacccttccgtattaaaagcgttgaaactgtatctatgatcccgcgtgatgaacgcctcaagagcatgcaggaagcgggttacaatactttcctgttaaactcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 224 - protein, 456 aa, Artificial sequence
  Engineered sequence
MNYPAEPFRIKSVETVSMIPRDERLKSMQEAGYNTFLLNSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 225 - DNA, 1368 bp, Artificial sequence
  Engineered sequence
atgaattatccggcagaacccttccgtattaaaagcgttgaaactgtatctatgatcccgcgtgatgaacgcctcaagcacatgcaggaagcgggttacaatactttcctgttaaactcgcgtgatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 226 - protein, 456 aa, Artificial sequence
  Engineered sequence
MNYPAEPFRIKSVETVSMIPRDERLKHMQEAGYNTFLLNSRDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 227 - DNA, 1368 bp, Artificial sequence
  Engineered sequence
atgaattatccggcagaacccttccgtattaaaagcgttgaaactgtatctatgatcccgcgtgatgaacgcctcaagaacatgcaggaagcgggttacaatactttcctgttacgctcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 228 - protein, 456 aa, Artificial sequence
  Engineered sequence
MNYPAEPFRIKSVETVSMIPRDERLKNMQEAGYNTFLLRSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 229 - DNA, 1368 bp, Artificial sequence
  Engineered sequence
atgaattatccggcagaacccttccgtattaaaagcgttgaaactgtatctatgatcccgcgtgatgaacgcctcaagcaaatgcaggaagcgggttacaatactttcctgttacgctcggcggatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 230 - protein, 456 aa, Artificial sequence
  Engineered sequence
MNYPAEPFRIKSVETVSMIPRDERLKQMQEAGYNTFLLRSADTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 231 - DNA, 1368 bp, Artificial sequence
  Engineered sequence
atgaattatccggcagaacccttccgtattaaaagcgttgaaactgtatctatgatcccgcgtgatgaacgcctcaagaacatgcaggaagcgggttacaatactttcctgttaaactcgcatgatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 232 - protein, 456 aa, Artificial sequence
  Engineered sequence
MNYPAEPFRIKSVETVSMIPRDERLKNMQEAGYNTFLLNSHDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 233 - DNA, 1368 bp, Artificial sequence
  Engineered sequence
atgaattatccggcagaacccttccgtattaaaagcgttgaaactgtatctatgatcccgcgtgatgaacgcctcaagcgcatgcaggaagcgggttacaatactttcctgttacgctcgcaggatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 234 - protein, 456 aa, Artificial sequence
  Engineered sequence
MNYPAEPFRIKSVETVSMIPRDERLKRMQEAGYNTFLLRSQDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 235 - DNA, 1368 bp, Artificial sequence
  Engineered sequence
atgaattatccggcagaacccttccgtattaaaagcgttgaaactgtatctatgatcccgcgtgatgaacgcctcaagacgatgcaggaagcgggttacaatactttcctgttaaaatcgaaggatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 236 - protein, 456 aa, Artificial sequence
  Engineered sequence
MNYPAEPFRIKSVETVSMIPRDERLKTMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 237 - DNA, 1368 bp, Artificial sequence
  Engineered sequence
atgaattatccggcagaacccttccgtattaaaagcgttgaaactgtatctatgatcccgcgtgatgaacgcctcaagaacatgcaggaagcgggttacaatactttcctgttacgctcggcggatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 238 - protein, 456 aa, Artificial sequence
  Engineered sequence
MNYPAEPFRIKSVETVSMIPRDERLKNMQEAGYNTFLLRSADTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 239 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttacgctcggcggatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 240 - protein, 456 aa, Artificial sequence
  Engineered sequence
MNYPAEPFRIKSVETVSMIPRDERLKKMQEAGYNTFLLRSADTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 241 - DNA, 1368 bp, Artificial sequence
  Engineered sequence
atgaattatccggcagaacccttccgtattaaaagcgttgaaactgtatctatgatcccgcgtgatgaacgcctcaagaacatgcaggaagcgggttacaatactttcctgttaaactcgcgcgatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 242 - protein, 456 aa, Artificial sequence
  Engineered sequence
MNYPAEPFRIKSVETVSMIPRDERLKNMQEAGYNTFLLNSRDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 243 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaaatcgcacgatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 244 - protein, 456 aa, Artificial sequence
  Engineered sequence
MNYPAEPFRIKSVETVSMIPRDERLKAMQEAGYNTFLLKSHDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 245 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttacgctcgaacgatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 246 - protein, 456 aa, Artificial sequence
  Engineered sequence
MNYPAEPFRIKSVETVSMIPRDERLKKMQEAGYNTFLLRSNDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 247 - DNA, 1368 bp, Artificial sequence
  Engineered sequence
atgaattatccggcagaacccttccgtattaaaagcgttgaaactgtatctatgatcccgcgtgatgaacgcctcaagaaaatgcaggaagcgggttacaatactttcctgttacgctcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 248 - protein, 456 aa, Artificial sequence
  Engineered sequence
MNYPAEPFRIKSVETVSMIPRDERLKKMQEAGYNTFLLRSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 249 - DNA, 1368 bp, Artificial sequence
  Engineered sequence
atgaattatccggcagaacccttccgtattaaaagcgttgaaactgtatctatgatcccgcgtgatgaacgcctcaagagcatgcaggaagcgggttacaatactttcctgttacgctcgaacgatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 250 - protein, 456 aa, Artificial sequence
  Engineered sequence
MNYPAEPFRIKSVETVSMIPRDERLKSMQEAGYNTFLLRSNDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 251 - DNA, 1368 bp, Artificial sequence
  Engineered sequence
atgaattatccggcagaacccttccgtattaaaagcgttgaaactgtatctatgatcccgcgtgatgaacgcctcaagcgcatgcaggaagcgggttacaatactttcctgttaaaatcgagcgatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 252 - protein, 456 aa, Artificial sequence
  Engineered sequence
MNYPAEPFRIKSVETVSMIPRDERLKRMQEAGYNTFLLKSSDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 253 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgcgtgatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 254 - protein, 456 aa, Artificial sequence
  Engineered sequence
MNYPAEPFRIKSVETVSMIPRDERLKAMQEAGYNTFLLKSRDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 255 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtactgtggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 256 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYCGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 257 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttcacgcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 258 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYAGSENFTHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 259 - DNA, 1368 bp, Artificial sequence
  Engineered sequence
atgaattatccggcagaacccttccgtattaaaagcgttgaaactgtatctatgatcccgcgtgatgaacgcctcaagcgcatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttttacgacgctacccgctgcgtagaaaacgcctactttatcaaagagcaagagcagggctttcaaaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 260 - protein, 456 aa, Artificial sequence
  Engineered sequence
MNYPAEPFRIKSVETVSMIPRDERLKRMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFQNKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 261 - DNA, 1368 bp, Artificial sequence
  Engineered sequence
atgaattatccggcagaacccttccgtattaaaagcgttgaaactgtatctatgatcccgcgtgatgaacgcctcaagcagatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttttacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 262 - protein, 456 aa, Artificial sequence
  Engineered sequence
MNYPAEPFRIKSVETVSMIPRDERLKQMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 263 - DNA, 1368 bp, Artificial sequence
  Engineered sequence
atgaattatccggcagaacccttccgtattaaaagcgttgaaactgtatctatgatcccgcgtgatgaacgcctcaagcgcatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttttacgacgctacccgctgcgtagaaaacgcctactttatcaaagagcaagagcagggctttgaaaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagggcttgcgtttctttactgcacgctttgaatacatc

SEQ ID NO: 264 - protein, 456 aa, Artificial sequence
  Engineered sequence
MNYPAEPFRIKSVETVSMIPRDERLKRMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKGLRFFTARFEYI

SEQ ID NO: 265 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgtattacgacgctacccgctgcgtagaaaacgcctactttatcaaagagcaagagcagggctttgaaaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 266 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVYYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 267 - DNA, 1368 bp, Artificial sequence
  Engineered sequence
atgaattatccggcagaacccttccgtattaaaagcgttgaaactgtatctatgatcccgcgtgatgaacgcctcaagcgtatgcaggaagcgggttacaatactttcctgttacgctcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 268 - protein, 456 aa, Artificial sequence
  Engineered sequence
MNYPAEPFRIKSVETVSMIPRDERLKRMQEAGYNTFLLRSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 269 - DNA, 1368 bp, Artificial sequence
  Engineered sequence
atgaattatccggcagaacccttccgtattaaaagcgttgaaactgtatctatgatcccgcgtgatgaacgcctcaagacgatgcaggaagcgggttacaatactttcctgttaaaatcgcaggatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 270 - protein, 456 aa, Artificial sequence
  Engineered sequence
MNYPAEPFRIKSVETVSMIPRDERLKTMQEAGYNTFLLKSQDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 271 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagccagaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 272 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYAGSQNFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 273 - DNA, 1368 bp, Artificial sequence
  Engineered sequence
atgaattatccggcagaacccttccgtattaaaagcgttgaaactgtacgtatgatcccgcgtgatgaacgcctcaaggcgatgaaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataataagaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 274 - protein, 456 aa, Artificial sequence
  Engineered sequence
MNYPAEPFRIKSVETVRMIPRDERLKAMKEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNKTGEHHRPKLETVRLTIPRRVYTYAHMDVVADGIIKLYQHKEDIRGLKFIYEPKQLRFFTARFEYI

SEQ ID NO: 275 - DNA, 1368 bp, Artificial sequence
  Engineered sequence
atgaattatccggcagaacccttccgtattaaaagcgttgaaactgtaagtatgatcccgcgtgatgaacgcctcaaggcgatgaaagaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaaaattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataatgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 276 - protein, 456 aa, Artificial sequence
  Engineered sequence
MNYPAEPFRIKSVETVSMIPRDERLKAMKEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAEKIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 277 - DNA, 1368 bp, Artificial sequence
  Engineered sequence
atgaattatccggcagaacccttccgtattaaaagcgttgaaactgtacgtatgatcccgcgtgatgaacgcctcaaggcgatgcaagaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataaagtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 278 - protein, 456 aa, Artificial sequence
  Engineered sequence
MNYPAEPFRIKSVETVRMIPRDERLKAMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNKVTGEHHRPKLETVRLTIPRRVYTYAHMDVVADGIIKLYQHKEDIRGLKFIYEPKQLRFFTARFEYI

SEQ ID NO: 279 - DNA, 1368 bp, Artificial sequence
  Engineered sequence
atgaattatccggcagaacccttccgtattaaaagcgttgaaactgtacgtatgatcccgcgtgatgaacgcctcaaggcgatgcaagaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaaaattgcgtatatctgccttgcggtgacggttaacctcgcgggcggccaaccggtctcgatggctaacatgcgtgcggtgcgtgaactgacagaaaagcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataatgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 280 - protein, 456 aa, Artificial sequence
  Engineered sequence
MNYPAEPFRIKSVETVRMIPRDERLKAMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAEKIAYICLAVTVNLAGGQPVSMANMRAVRELTEKHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 281 - DNA, 1368 bp, Artificial sequence
  Engineered sequence
atgaattatccggcagaacccttccgtattaaaagcgttgaaactgtaagtatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaaaattgcgtatatctgccttgcggtgacggttaacctcgcgggcggccaaccggtctcgatggctaacatgcgtgcggtgcgtgaactgacagaaaagcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataatgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 282 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAEKIAYICLAVTVNLAGGQPVSMANMRAVRELTEKHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 283 - DNA, 1368 bp, Artificial sequence
  Engineered sequence
atgaattatccggcagaacccttccgtattaaaagcgttgaaactgtacgtatgatcccgcgtgatgaacgcctcaaggcgatgcaagaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaaaagcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataaaaagaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 284 - protein, 456 aa, Artificial sequence
  Engineered sequence
MNYPAEPFRIKSVETVRMIPRDERLKAMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEKHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNKKTGEHHRPKLETVRLTIPRRVYTYAHMDVVADGIIKLYQHKEDIRGLKFIYEPKQLRFFTARFEYI

SEQ ID NO: 285 - DNA, 1368 bp, Artificial sequence
  Engineered sequence
atgaattatccggcagaacccttccgtattaaaagcgttgaaactgtaaaaatgatcccgcgtgatgaacgcctcaaggcgatgaaagaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaaaattgcgtatatctgccttgcggtgacggttaacctcgcgggcggccaaccggtctcgatggctaacatgcgtgcggtgcgtgaactgacagaaaagcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataaagtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 286 - protein, 456 aa, Artificial sequence
  Engineered sequence
MNYPAEPFRIKSVETVKMIPRDERLKAMKEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAEKIAYICLAVTVNLAGGQPVSMANMRAVRELTEKHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNKVTGEHHRPKLETVRLTIPRRVYTYAHMDVVADGIIKLYQHKEDIRGLKFIYEPKQLRFFTARFEYI

SEQ ID NO: 287 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagccgcaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaaaacttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagaccttgcgtttctttactgcacgctttgaatacatc

SEQ ID NO: 288 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYAGSRNFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKNLVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKTLRFFTARFEYI

SEQ ID NO: 289 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcggatgatacctatattgacctgctgacagacagtggcactaacgcaatgagcgacaagcagtgggccggaatgatgatgggtgatgaagcgtacgcgggcagccgcaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttcgaatctgccaaaaacttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagtacttgcgtttctttactgcacgctttgaatacatc

SEQ ID NO: 290 - protein, 456 aa, Artificial sequence
  Engineered sequence
MNYPAEPFRIKSVETVSMIPRDERLKAMQEAGYNTFLLKSDDTYIDLLTDSGTNAMSDKQWAGMMMGDEAYAGSRNFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFESAKNLVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKYLRFFTARFEYI

SEQ ID NO: 291 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcggatgatacctatattgacctgctgacagacagtggcactaacgcaatgagcgacaagcagtgggccggaatgatgatgggtgatgaagcgtacgcgggcagccgcaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttcgaatctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagaccttgcgtttctttactgcacgctttgaatacatc

SEQ ID NO: 292 - protein, 456 aa, Artificial sequence
  Engineered sequence
MNYPAEPFRIKSVETVSMIPRDERLKAMQEAGYNTFLLKSDDTYIDLLTDSGTNAMSDKQWAGMMMGDEAYAGSRNFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFESAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKTLRFFTARFEYI

SEQ ID NO: 293 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagtacttgcgtttctttactgcacgctttgaatacatc

SEQ ID NO: 294 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKYLRFFTARFEYI

SEQ ID NO: 295 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagccgcaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagaccttgcgtttctttactgcacgctttgaatacatc

SEQ ID NO: 296 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYAGSRNFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKTLRFFTARFEYI

SEQ ID NO: 297 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcaaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttcgaatctgccaaaaacttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 298 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYAGSKNFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFESAKNLVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

SEQ ID NO: 299 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagccgcaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttcgaatctgccaaaaacttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagaccttgcgtttctttactgcacgctttgaatacatc

SEQ ID NO: 300 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYAGSRNFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFESAKNLVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKTLRFFTARFEYI

SEQ ID NO: 301 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcggaagatacctatattgacctgctgacagacagtggcactaacgcaatgagcgacaagcagtgggccggaatgatgatgggtgatgaagcgtacgcgggcagcaaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttcgaatctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagtacttgcgtttctttactgcacgctttgaatacatc

SEQ ID NO: 302 - protein, 456 aa, Artificial sequence
  Engineered sequence
MNYPAEPFRIKSVETVSMIPRDERLKAMQEAGYNTFLLKSEDTYIDLLTDSGTNAMSDKQWAGMMMGDEAYAGSKNFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFESAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKYLRFFTARFEYI

SEQ ID NO: 303 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcggaagatacctatattgacctgctgacagacagtggcactaacgcaatgagcgacaagcagtgggccggaatgatgatgggtgatgaagcgtacgcgggcagccgcaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttcgaatctgccaaaaacttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagaccttgcgtttctttactgcacgctttgaatacatc

SEQ ID NO: 304 - protein, 456 aa, Artificial sequence
  Engineered sequence
MNYPAEPFRIKSVETVSMIPRDERLKAMQEAGYNTFLLKSEDTYIDLLTDSGTNAMSDKQWAGMMMGDEAYAGSRNFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFESAKNLVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKTLRFFTARFEYI

SEQ ID NO: 305 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagatacctatattgacctgctgacagacagtggcactaacgcaatgagcgacaagcagtgggccggaatgatgatgggtgatgaagcgtacgcgggcagcaaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaaaacttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagaccttgcgtttctttactgcacgctttgaatacatc

SEQ ID NO: 306 - protein, 456 aa, Artificial sequence
  Engineered sequence
MNYPAEPFRIKSVETVSMIPRDERLKAMQEAGYNTFLLKSKDTYIDLLTDSGTNAMSDKQWAGMMMGDEAYAGSKNFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKNLVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKTLRFFTARFEYI

SEQ ID NO: 307 - DNA, 1368 bp, Artificial sequence
  Engineered sequence
atgaattatccggcagaacccttccgtattaaaagcgttgaaactgtatctatgatcccgcgtgatgaacgcctcaaggcgatgcaggaagcgggttacaatactttcctgttaaagtcgaaagattgttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgcggggaatatgtatttcactaccacccgttatcaccaggaacggaatggtgcgacctttgtcgatgtggttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaaggggcgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcccgcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgaatacatc

SEQ ID NO: 308 - protein, 456 aa, Artificial sequence
  Engineered sequence
MNYPAEPFRIKSVETVSMIPRDERLKAMQEAGYNTFLLKSKDCYIDLLTDSGTNAMSDKQWAGMMMGDEAYAGSENFYHLERTVQELFGFKHIVPTHQGRGAENLLSQLAIKPGQYVAGNMYFTTTRYHQERNGATFVDVVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGAPSYGGLAGRDMEAMAIGLREAMQYEYIEHRVKQVRYLGDKLKAAGVPIVEPVGGHAVFLDARRFCPHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFEYI

The invention claimed is:

1. An engineered polypeptide that catalyzes the synthesis of L-tyrosine in enantiomeric excess, said polypeptide comprising an amino acid sequence having at least one amino acid substitution relative to SEQ ID NO: 2, wherein said at least one amino acid substitution is selected from the group consisting of X132R, X354P, X454E, and combinations thereof, further wherein said amino acid sequence is selected from the group consisting of SEQ ID No: 6, 8, 10, 12, 14, 16, 18, 20, 22, 24, 26, 28, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, and 308.

2. The engineered polypeptide of claim 1, wherein said engineered polypeptide is capable of catalyzing the synthesis of L-tyrosine with greater stability or activity than the polypeptide of SEQ ID NO: 2 and in an enantiomeric excess of at least 90% or more under reaction conditions defined as including about 3 g/L to 100 g/L of phenol at a pH of about 4.0-11.0 and a temperature of about 10-60° C.

3. An engineered polypeptide, which is a polypeptide of (a) or (b) below:
(a) a polypeptide comprising an amino acid sequence selected from the group consisting of SEQ ID No: 6, 8, 10, 12, 14, 16, 18, 20, 22, 24, 26, 28, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, and 308; or
(b) a polypeptide having tyrosine phenol-lyase activity, which comprises an amino acid sequence having (i) at least 95% sequence identity to one of the amino acid sequences recited in (a), and (ii) more of X132R, X354P, and X454E amino acid substitutions relative to said one amino acid sequence recited in (a).

4. An engineered polypeptide according to claim 3 that is, under suitable reaction conditions, capable of catalyzing the synthesis of L-tyrosine with greater stability and/or activity than the polypeptide of SEQ ID NO: 2, wherein L-tyrosine is produced in an enantiomeric excess of at least 90% or more.

5. A polypeptide immobilized on a solid material by a chemical bond or a physical adsorption method, wherein the polypeptide is an engineered polypeptide according to claim 1.

6. A polynucleotide encoding the engineered polypeptide according to claim 1.

7. The polynucleotide of claim 6, wherein the polynucleotide sequence is selected from among SEQ ID No: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, and 307.

8. An expression vector comprising the polynucleotide of claim 6.

9. The expression vector of claim 8, wherein said vector is a plasmid, a cosmid, a bacteriophage or a viral vector.

10. A host cell comprising the expression vector of claim 8.

11. A method for preparing an engineered polypeptide, wherein said method comprises the steps of culturing the host cell of claim 10 and obtaining an engineered polypeptide from the culture.

12. An enzyme catalyst obtained by culturing host cells, each of which carries an expression vector comprising a polynucleotide encoding a polypeptide of claim 1, wherein said enzyme catalyst comprises cells or culture fluid containing said engineered polypeptide, or an article processed therewith, further wherein the article is an extract obtained from the culture of transformant cell, an isolated product obtained by isolating or purifying said enzyme from the extract, or an immobilized product obtained by immobilizing a transformant cell, an extract thereof, or an isolated product of the extract.

13. A process of preparing a compound of formula (I):

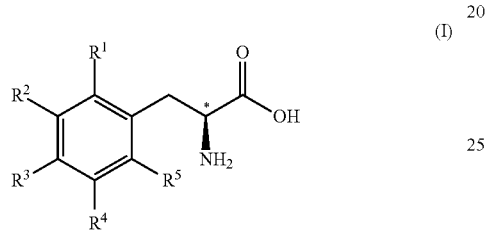

in which the amino acid products of formula (I) have the indicated stereochemical configuration shown at the chiral center marked with * and the amino acid products of formula (I) are in enantiomer excess over the other isomers, wherein:

$R^1$, $R^2$, $R^3$, $R^4$ or $R^5$ are each an optionally substituted or unsubstituted $C_1$-$C_6$ hydrocarbyl, —H, halogen selected from among —F, —Cl, —Br and —I, —OH, alkenyl, alkynyl, aryl, heteroaryl, —NO$_2$, —NO, —SO$_2$R' or —SOR', —SR', —NR'R', —OR', —CO$_2$R' or —COR', —C(O)NR', —SO$_2$NH$_2$, —SONH$_2$, —CN, and CF$_3$; and each R' is independently selected from the group consisting of —H, (C$_1$-C$_4$) hydrocarbyl, halogen, C$_1$-C$_8$ hydrocarbyl, C$_2$-C$_{12}$ alkenyl, C$_2$-C$_{12}$ alkynyl, cycloalkyl, aryl and heterocyclic;

wherein said process comprises the step of contacting, under suitable reaction conditions and in the presence of pyruvate and ammonia or in the presence of serine, the engineered polypeptide of claim 1 with the substrate of formula (II)

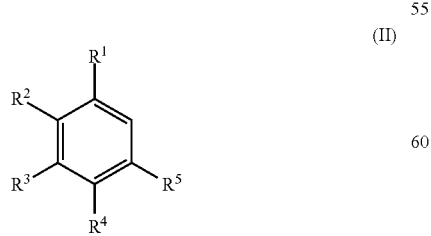

14. The process of claim 13, wherein the compound of formula (I) is

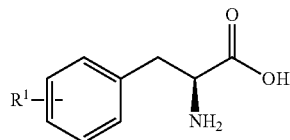

wherein $R^1$ is selected from the group consisting of an optionally substituted or unsubstituted $C_1$-$C_6$ hydrocarbyl, —H, a halogen selected from among —F, —Cl, —Br, and —I, —OH, alkenyl, alkynyl, aryl, heteroaryl, —NO$_2$, —NO, —SO$_2$R, —SOR', —SR', —NR'R', —OR', —CO$_2$R', —COR', —C(O)NR', —SO$_2$NH$_2$, —SONH$_2$, —CN, and —CF$_3$; wherein each R' is independently selected from the group consisting of —H, (C$_1$-C$_4$) hydrocarbyl, halogen, C$_1$-C$_8$ hydrocarbyl, C$_2$-C$_{12}$ alkenyl, C$_2$-C$_{12}$ alkynyl, cycloalkyl, aryl and heterocyclic; and the substrate of formula (II) is:

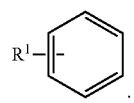

15. The process of claim 14, wherein $R^1$ is in (a) the para position of the phenyl ring, (b) in the meta position of the phenyl ring, (c) in the ortho position of the phenyl ring, (d) in both the para and meta positions of the phenyl ring, (e) in both the para and ortho positions of the phenyl ring, or (f) in both the meta and ortho positions of the phenyl ring.

16. A process for preparing L-tyrosine:

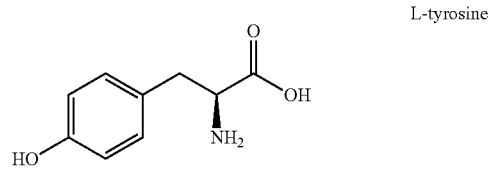 [SMILES: N[C@@H](Cc1ccc(O)cc1)C(=O)O]

said the process comprising the step of converting, under suitable reaction conditions, a compound of formula A1 to L-tyrosine by contacting an engineered polypeptide of claim 1 with a compound of formula A1

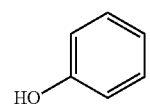

in the presence of pyruvate and ammonia, or in the presence of serine.

17. A process for preparing L-DOPA:

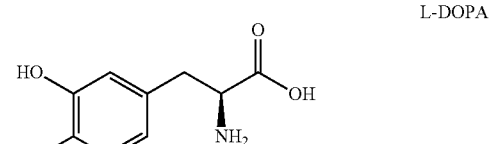

said process comprising the step of converting, under suitable reaction conditions, a compound of formula A2 to L-DOPA by contacting an engineered polypeptide of claim 1 with a compound of formula A2

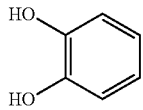

A2 in the presence of pyruvate and ammonia, or in the presence of serine.

18. The process of claim 13, wherein the chiral amino acid product is produced in an enantiomeric excess of at least 90% or more.

19. The process of claim 13, wherein the reaction solvent is selected from the group consisting of water, methanol, ethanol, propanol, isopropanol, isopropyl acetate, dimethyl sulfoxide (DMSO) and dimethylformamide (DMF).

20. The process of claim 13, wherein the reaction is performed at a temperature of 10° C. to 60° C.

21. The process of claim 13, wherein the reaction conditions comprise a pH 4.0 to pH 11.0.

22. The process of claim 13, wherein the substrate is added to the reaction system either in different batches at different times or by continuous dosing, and the final product concentration includes 10 g/L to 400 g/L.

* * * * *